(12) United States Patent
Guerlavais et al.

(10) Patent No.: US 9,957,299 B2
(45) Date of Patent: *May 1, 2018

(54) PEPTIDOMIMETIC MACROCYCLES

(71) Applicant: AILERON THERAPEUTICS, INC., Cambridge, MA (US)

(72) Inventors: Vincent Guerlavais, Arlington, MA (US); Noriyuki Kawahata, West Roxbury, MA (US)

(73) Assignee: AILERON THERAPEUTICS, INC., Cambridge, MA (US)

( * ) Notice: Subject to any disclaimer, the term of this patent is extended or adjusted under 35 U.S.C. 154(b) by 0 days. days.

This patent is subject to a terminal disclaimer.

(21) Appl. No.: 15/135,098

(22) Filed: Apr. 21, 2016

(65) Prior Publication Data

US 2016/0257716 A1    Sep. 8, 2016

Related U.S. Application Data

(60) Continuation of application No. 14/460,848, filed on Aug. 15, 2014, which is a division of application No. 13/816,880, filed as application No. PCT/US2011/047692 on Aug. 13, 2011, now Pat. No. 8,859,723.

(60) Provisional application No. 61/373,638, filed on Aug. 13, 2010, provisional application No. 61/373,701, filed on Aug. 13, 2010, provisional application No. 61/374,163, filed on Aug. 16, 2010.

(51) Int. Cl.
| | | |
|---|---|---|
| A61K 38/00 | (2006.01) |
| C07K 7/64 | (2006.01) |
| C07K 14/47 | (2006.01) |
| C07K 7/56 | (2006.01) |

(52) U.S. Cl.
CPC .............. *C07K 7/64* (2013.01); *C07K 7/56* (2013.01); *C07K 14/4746* (2013.01); *A61K 38/00* (2013.01)

(58) Field of Classification Search
None
See application file for complete search history.

(56) References Cited

U.S. PATENT DOCUMENTS

| | | |
|---|---|---|
| 4,000,259 A | 12/1976 | Garsky |
| 4,191,754 A | 3/1980 | Nutt et al. |
| 4,270,537 A | 6/1981 | Romaine |
| 4,438,270 A | 3/1984 | Bey et al. |
| 4,518,586 A | 5/1985 | Rivier et al. |
| 4,596,556 A | 6/1986 | Morrow et al. |
| 4,683,195 A | 7/1987 | Mullis et al. |
| 4,683,202 A | 7/1987 | Mullis |
| 4,728,726 A | 3/1988 | Rivier et al. |
| 4,730,006 A | 3/1988 | Bohme et al. |
| 4,737,465 A | 4/1988 | Bond et al. |
| 4,790,824 A | 12/1988 | Morrow et al. |
| 4,880,778 A | 11/1989 | Bowers et al. |
| 4,886,499 A | 12/1989 | Cirelli et al. |
| 4,940,460 A | 7/1990 | Casey et al. |
| 4,941,880 A | 7/1990 | Burns |
| 5,015,235 A | 5/1991 | Crossman |
| 5,036,045 A | 7/1991 | Thorner |
| 5,043,322 A | 8/1991 | Rivier et al. |
| 5,064,413 A | 11/1991 | McKinnon et al. |
| 5,094,951 A | 3/1992 | Rosenberg |
| 5,112,808 A | 5/1992 | Coy et al. |
| 5,120,859 A | 6/1992 | Webb |
| 5,141,496 A | 8/1992 | Dalto et al. |
| 5,169,932 A | 12/1992 | Hoeger et al. |
| 5,190,521 A | 3/1993 | Hubbard et al. |
| 5,245,009 A | 9/1993 | Kornreich et al. |
| 5,262,519 A | 11/1993 | Rivier et al. |
| 5,296,468 A | 3/1994 | Hoeger et al. |
| 5,310,910 A | 5/1994 | Drtina et al. |
| 5,312,335 A | 5/1994 | McKinnon et al. |
| 5,323,907 A | 6/1994 | Kalvelage |
| 5,328,483 A | 7/1994 | Jacoby |
| 5,334,144 A | 8/1994 | Alchas et al. |
| 5,339,163 A | 8/1994 | Homma et al. |
| 5,352,796 A | 10/1994 | Hoeger et al. |
| 5,364,851 A | 11/1994 | Joran |
| 5,371,070 A | 12/1994 | Koerber et al. |
| 5,383,851 A | 1/1995 | McKinnon, Jr. et al. |
| 5,384,309 A | 1/1995 | Barker et al. |
| 5,416,073 A | 5/1995 | Coy et al. |
| 5,417,662 A | 5/1995 | Hjertman et al. |
| 5,446,128 A | 8/1995 | Kahn |
| 5,453,418 A | 9/1995 | Anderson et al. |
| 5,466,220 A | 11/1995 | Brenneman |
| 5,480,381 A | 1/1996 | Weston |

(Continued)

FOREIGN PATENT DOCUMENTS

| | | | |
|---|---|---|---|
| CA | 2761253 A1 | 6/2013 |
| CN | 1252808 A | 5/2000 |

(Continued)

OTHER PUBLICATIONS

Al-Lazikani, et al. Combinatorial drug therapy for cancer in the post-genomic era. Nature biotechnology 30.7 (2012): 679-692.
Altschul et al. Basic local alignment search tool. J Mol Biol215(3):403-410 (1990).
Annis, et al. A general technique to rank protein-ligand binding affinities and determine allosteric versus direct binding site competition in compound mixtures. J Am Chem Soc. Dec. 1, 2004;126(47):15495-503.
Balthaser et al., Remodelling of the natural product fumagillol employing a reaction discovery approach. Nat Chem. Dec. 2011;3(12):969-73.
Bansal, et al. Salt selection in drug development. Pharmaceutical Technology. Mar. 2, 2008;3(32).

(Continued)

*Primary Examiner* — Jennifer Pitrak McDonald
*Assistant Examiner* — Sergio Coffa
(74) *Attorney, Agent, or Firm* — Wilson Sonsini Goodrich & Rosati

(57) ABSTRACT

The present invention provides novel peptidomimetic macrocycles and methods of using such macrocycles for the treatment of disease.

22 Claims, 17 Drawing Sheets

(56) References Cited

U.S. PATENT DOCUMENTS

| | | |
|---|---|---|
| 5,503,627 A | 4/1996 | McKinnon et al. |
| 5,506,207 A | 4/1996 | Rivier et al. |
| 5,520,639 A | 5/1996 | Peterson et al. |
| 5,527,288 A | 6/1996 | Gross et al. |
| 5,552,520 A | 9/1996 | Kim et al. |
| 5,569,189 A | 10/1996 | Parsons |
| 5,580,957 A | 12/1996 | Hoeger et al. |
| 5,599,302 A | 2/1997 | Lilley et al. |
| 5,620,708 A | 4/1997 | Amkraut et al. |
| 5,622,852 A | 4/1997 | Korsmeyer |
| 5,629,020 A | 5/1997 | Leone-Bay et al. |
| 5,635,371 A | 6/1997 | Stout et al. |
| 5,643,957 A | 7/1997 | Leone-Bay et al. |
| 5,649,912 A | 7/1997 | Peterson |
| 5,650,133 A | 7/1997 | Carvalho et al. |
| 5,650,386 A | 7/1997 | Leone-Bay et al. |
| 5,656,721 A | 8/1997 | Albert et al. |
| 5,663,316 A | 9/1997 | Xudong |
| 5,672,584 A | 9/1997 | Borchardt et al. |
| 5,681,928 A | 10/1997 | Rivier et al. |
| 5,700,775 A | 12/1997 | Gutniak et al. |
| 5,702,908 A | 12/1997 | Picksley et al. |
| 5,704,911 A | 1/1998 | Parsons |
| 5,708,136 A | 1/1998 | Burrell et al. |
| 5,710,245 A | 1/1998 | Kahn |
| 5,710,249 A | 1/1998 | Hoeger et al. |
| 5,731,408 A | 3/1998 | Hadley et al. |
| 5,744,450 A | 4/1998 | Hoeger et al. |
| 5,750,499 A | 5/1998 | Hoeger et al. |
| 5,750,767 A | 5/1998 | Carpino et al. |
| 5,756,669 A | 5/1998 | Bischoff et al. |
| 5,770,377 A | 6/1998 | Picksley et al. |
| 5,792,747 A | 8/1998 | Schally et al. |
| 5,807,983 A | 9/1998 | Jiang et al. |
| 5,811,515 A | 9/1998 | Grubbs et al. |
| 5,817,752 A | 10/1998 | Yu |
| 5,817,789 A | 10/1998 | Heartlein et al. |
| 5,824,483 A | 10/1998 | Houston, Jr. et al. |
| 5,834,209 A | 11/1998 | Korsmeyer |
| 5,837,845 A | 11/1998 | Hosokawa et al. |
| 5,840,833 A | 11/1998 | Kahn |
| 5,846,936 A | 12/1998 | Felix et al. |
| 5,847,066 A | 12/1998 | Coy et al. |
| 5,854,216 A | 12/1998 | Gaudreau |
| 5,856,445 A | 1/1999 | Korsmeyer |
| 5,859,184 A | 1/1999 | Kahn et al. |
| 5,861,379 A | 1/1999 | Ibea et al. |
| 5,874,529 A | 2/1999 | Gilon et al. |
| 5,893,397 A | 4/1999 | Peterson et al. |
| 5,922,863 A | 7/1999 | Grubbs et al. |
| 5,939,386 A | 8/1999 | Ibea et al. |
| 5,939,387 A | 8/1999 | Broderick et al. |
| 5,955,593 A | 9/1999 | Korsmeyer |
| 5,965,703 A | 10/1999 | Horne et al. |
| 5,993,412 A | 11/1999 | Deily et al. |
| 5,998,583 A | 12/1999 | Korsmeyer |
| 6,020,311 A | 2/2000 | Brazeau et al. |
| 6,030,997 A | 2/2000 | Eilat et al. |
| 6,031,073 A | 2/2000 | Yu |
| 6,043,339 A | 3/2000 | Lin et al. |
| 6,046,289 A | 4/2000 | Komazawa et al. |
| 6,051,513 A | 4/2000 | Kumazawa et al. |
| 6,051,554 A | 4/2000 | Hornik et al. |
| 6,054,556 A | 4/2000 | Huby et al. |
| 6,060,513 A | 5/2000 | Leone-Bay et al. |
| 6,066,470 A | 5/2000 | Nishimura et al. |
| 6,071,510 A | 6/2000 | Leone-Bay et al. |
| 6,071,538 A | 6/2000 | Milstein et al. |
| 6,071,926 A | 6/2000 | Van Cauter et al. |
| 6,090,958 A | 7/2000 | Leone-Bay et al. |
| 6,100,298 A | 8/2000 | Leone-Bay et al. |
| 6,118,010 A | 9/2000 | Ueda et al. |
| 6,123,964 A | 9/2000 | Asgharnejad et al. |
| 6,127,341 A | 10/2000 | Hansen et al. |
| 6,127,354 A | 10/2000 | Peschke et al. |
| 6,127,391 A | 10/2000 | Hansen et al. |
| 6,153,391 A | 11/2000 | Picksley et al. |
| 6,169,073 B1 | 1/2001 | Halazonetis et al. |
| 6,177,076 B1 | 1/2001 | Lattime et al. |
| 6,177,542 B1 | 1/2001 | Ruoslahti et al. |
| 6,184,344 B1 | 2/2001 | Kent et al. |
| 6,190,699 B1 | 2/2001 | Luzzi et al. |
| 6,194,384 B1 | 2/2001 | Brazeau et al. |
| 6,194,402 B1 | 2/2001 | Bach et al. |
| 6,204,361 B1 | 3/2001 | Carpino et al. |
| 6,245,359 B1 | 6/2001 | Milstein et al. |
| 6,245,886 B1 | 6/2001 | Halazonetis et al. |
| 6,248,358 B1 | 6/2001 | Bologna et al. |
| 6,271,198 B1 | 8/2001 | Braisted et al. |
| 6,274,584 B1 | 8/2001 | Peschke et al. |
| 6,287,787 B1 | 9/2001 | Houghten et al. |
| 6,307,017 B1 | 10/2001 | Coy et al. |
| 6,309,859 B1 | 10/2001 | Nishimura et al. |
| 6,313,088 B1 | 11/2001 | Leone-Bay et al. |
| 6,313,133 B1 | 11/2001 | Van Cauter et al. |
| 6,326,354 B1 | 12/2001 | Gross et al. |
| 6,331,318 B1 | 12/2001 | Milstein |
| 6,344,213 B1 | 2/2002 | Leone-Bay et al. |
| 6,346,264 B1 | 2/2002 | White |
| 6,348,558 B1 | 2/2002 | Harris et al. |
| 6,368,617 B1 | 4/2002 | Hastings et al. |
| 6,420,118 B1 | 7/2002 | Halazonetis et al. |
| 6,420,136 B1 | 7/2002 | Riabowol et al. |
| 6,444,425 B1 | 9/2002 | Reed et al. |
| 6,458,764 B1 | 10/2002 | Gravel et al. |
| 6,461,634 B1 | 10/2002 | Marshall |
| 6,495,589 B2 | 12/2002 | Hay et al. |
| 6,495,674 B1 | 12/2002 | Lemke et al. |
| 6,514,685 B1 | 2/2003 | Moro |
| 6,548,501 B2 | 4/2003 | Hakkinen |
| 6,555,156 B1 | 4/2003 | Loughman |
| 6,555,570 B2 | 4/2003 | Hansen et al. |
| 6,569,993 B1 | 5/2003 | Sledeski et al. |
| 6,572,856 B1 | 6/2003 | Taylor et al. |
| 6,579,967 B1 | 6/2003 | Rivier et al. |
| 6,610,657 B1 | 8/2003 | Goueli |
| 6,613,874 B1 | 9/2003 | Mazur et al. |
| 6,617,360 B1 | 9/2003 | Bailey et al. |
| 6,620,808 B2 | 9/2003 | Van Der Klish et al. |
| 6,635,740 B1 | 10/2003 | Enright et al. |
| 6,641,840 B2 | 11/2003 | Am Ende et al. |
| 6,686,148 B1 | 2/2004 | Shen et al. |
| 6,696,063 B1 | 2/2004 | Torres |
| 6,696,418 B1 | 2/2004 | Hay et al. |
| 6,703,382 B2 | 3/2004 | Wang et al. |
| 6,713,280 B1 | 3/2004 | Huang et al. |
| 6,720,330 B2 | 4/2004 | Hay et al. |
| 6,747,125 B1 | 6/2004 | Hoeger et al. |
| 6,784,157 B2 | 8/2004 | Halazonetis et al. |
| 6,849,428 B1 | 2/2005 | Evans et al. |
| 6,852,722 B2 | 2/2005 | Hakkinen |
| 6,875,594 B2 | 4/2005 | Muir et al. |
| 6,897,286 B2 | 5/2005 | Jaspers et al. |
| 6,939,880 B2 | 9/2005 | Hansen et al. |
| 7,019,109 B2 | 3/2006 | Rivier et al. |
| 7,034,050 B2 | 4/2006 | Deghenghi |
| 7,064,193 B1 | 6/2006 | Cory et al. |
| 7,083,983 B2 | 8/2006 | Lane et al. |
| 7,084,244 B2 | 8/2006 | Gilon et al. |
| 7,115,372 B2 | 10/2006 | Shen et al. |
| 7,144,577 B2 | 12/2006 | Torres |
| 7,166,461 B2 | 1/2007 | Schwartz et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,238,775 B2 | 7/2007 | Rivier et al. |
| 7,247,700 B2 | 7/2007 | Korsmeyer et al. |
| 7,268,113 B2 | 9/2007 | Bridon et al. |
| 7,312,304 B2 | 12/2007 | Coy et al. |
| 7,316,997 B2 | 1/2008 | Abribat et al. |
| 7,414,107 B2 | 8/2008 | Larsen et al. |
| 7,425,542 B2 | 9/2008 | Maggio |
| 7,445,919 B2 | 11/2008 | Jaspers et al. |

(56) References Cited

U.S. PATENT DOCUMENTS

| | | |
|---|---|---|
| 7,476,653 B2 | 1/2009 | Hoveyda et al. |
| 7,485,620 B2 | 2/2009 | Ghigo et al. |
| 7,491,695 B2 | 2/2009 | Fraser et al. |
| 7,521,420 B2 | 4/2009 | Fraser et al. |
| 7,538,190 B2 | 5/2009 | Robinson et al. |
| 7,566,777 B2 | 7/2009 | Enright et al. |
| 7,638,138 B2 | 12/2009 | Oki et al. |
| 7,655,447 B2 | 2/2010 | Jaspers et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,737,174 B2 | 6/2010 | Wang et al. |
| 7,745,573 B2 | 6/2010 | Robinson et al. |
| 7,759,383 B2 | 7/2010 | Wang et al. |
| 7,786,072 B2 | 8/2010 | Verdine et al. |
| 7,829,724 B2 | 11/2010 | Perrissoud et al. |
| RE42,013 E | 12/2010 | Hoveyda et al. |
| 7,884,073 B2 | 2/2011 | Guyon et al. |
| 7,884,107 B2 | 2/2011 | Ma et al. |
| 7,888,056 B2 | 2/2011 | Sheppard et al. |
| 7,893,025 B2 | 2/2011 | Lussier et al. |
| 7,893,278 B2 | 2/2011 | Haley et al. |
| 7,927,813 B2 | 4/2011 | Geneste et al. |
| 7,932,397 B2 | 4/2011 | Hock et al. |
| 7,960,342 B2 | 6/2011 | Rivier et al. |
| 7,960,506 B2 | 6/2011 | Nash |
| 7,964,724 B2 | 6/2011 | Fotouhi et al. |
| 7,981,998 B2 | 7/2011 | Nash |
| 7,981,999 B2 | 7/2011 | Nash |
| RE42,624 E | 8/2011 | Fraser |
| 7,994,329 B2 | 8/2011 | Anderson et al. |
| 7,998,927 B2 | 8/2011 | Maggio |
| 7,998,930 B2 | 8/2011 | Guyon et al. |
| 8,017,607 B2 | 9/2011 | Bartkovitz et al. |
| 8,039,456 B2 | 10/2011 | Polvino et al. |
| 8,039,457 B2 | 10/2011 | Polvino |
| 8,058,269 B2 | 11/2011 | Chen et al. |
| 8,071,541 B2 | 12/2011 | Arora et al. |
| 8,076,290 B2 | 12/2011 | Maggio |
| 8,076,482 B2 | 12/2011 | Chen et al. |
| 8,084,022 B2 | 12/2011 | Maggio |
| 8,088,733 B2 | 1/2012 | Fraser et al. |
| 8,088,815 B2 | 1/2012 | Bartkovitz et al. |
| 8,088,931 B2 | 1/2012 | Wang et al. |
| 8,124,356 B2 | 2/2012 | Sheppard et al. |
| 8,124,726 B2 | 2/2012 | Robinson et al. |
| 8,129,561 B2 | 3/2012 | Marsault et al. |
| 8,133,863 B2 | 3/2012 | Maggio |
| 8,173,594 B2 | 5/2012 | Maggio |
| 8,192,719 B2 | 6/2012 | Larsen |
| 8,198,405 B2 | 6/2012 | Walensky et al. |
| 8,217,051 B2 | 7/2012 | Zhang et al. |
| 8,222,209 B2 | 7/2012 | Guyon et al. |
| 8,226,949 B2 | 7/2012 | Maggio |
| 8,314,066 B2 | 11/2012 | Abribat et al. |
| 8,324,428 B2 | 12/2012 | Verdine et al. |
| 8,334,256 B2 | 12/2012 | Marsault et al. |
| 8,343,760 B2 | 1/2013 | Lu et al. |
| 8,349,887 B2 | 1/2013 | Fraser et al. |
| 8,389,484 B2 | 3/2013 | Shen et al. |
| 8,399,405 B2 | 3/2013 | Nash et al. |
| 8,524,653 B2 | 9/2013 | Nash et al. |
| 8,592,377 B2 | 11/2013 | Verdine et al. |
| 8,609,809 B2 | 12/2013 | Nash |
| 8,637,686 B2 | 1/2014 | Nash |
| 8,796,418 B2 | 8/2014 | Walensky et al. |
| 8,808,694 B2 | 8/2014 | Nash et al. |
| 8,859,723 B2 | 10/2014 | Guerlavais et al. |
| 8,871,899 B2 | 10/2014 | Wang et al. |
| 8,889,632 B2 | 11/2014 | Bernal et al. |
| 8,895,699 B2 | 11/2014 | Verdine et al. |
| 8,927,500 B2 | 1/2015 | Guerlavais et al. |
| 8,957,026 B2 | 2/2015 | Verdine et al. |
| 8,987,414 B2 | 3/2015 | Guerlavais et al. |
| 9,023,988 B2 | 5/2015 | Nash |
| 9,096,684 B2 | 8/2015 | Kawahata et al. |
| 9,163,330 B2 | 10/2015 | Verdine et al. |
| 9,175,045 B2 | 11/2015 | Nash et al. |
| 9,175,047 B2 | 11/2015 | Nash et al. |
| 9,175,056 B2 | 11/2015 | Nash |
| 9,206,223 B2 | 12/2015 | Nash et al. |
| 9,273,031 B2 | 3/2016 | Errico et al. |
| 9,273,099 B2 | 3/2016 | Walensky et al. |
| 9,381,228 B2 | 7/2016 | Robson et al. |
| 9,394,336 B2 | 7/2016 | Nash et al. |
| 9,408,885 B2 | 8/2016 | Marine et al. |
| 9,458,202 B2 | 10/2016 | Nash et al. |
| 9,464,115 B2 | 10/2016 | Walensky et al. |
| 9,486,445 B2 | 11/2016 | Higgins et al. |
| 9,505,804 B2 | 11/2016 | Guerlavais et al. |
| 9,522,947 B2 | 12/2016 | Kawahata et al. |
| 9,527,896 B2 | 12/2016 | Bernal et al. |
| 2001/0047030 A1 | 11/2001 | Hay et al. |
| 2002/0002198 A1 | 1/2002 | Parr |
| 2002/0013320 A1 | 1/2002 | Busch et al. |
| 2002/0016298 A1 | 2/2002 | Hay et al. |
| 2002/0028838 A1 | 3/2002 | MacLean et al. |
| 2002/0055156 A1 | 5/2002 | Jaspers et al. |
| 2002/0061838 A1 | 5/2002 | Holmquist et al. |
| 2002/0091090 A1 | 7/2002 | Cole et al. |
| 2002/0091125 A1 | 7/2002 | Hay et al. |
| 2002/0094992 A1 | 7/2002 | MacLean |
| 2002/0098580 A1 | 7/2002 | Nandabalan et al. |
| 2002/0103221 A1 | 8/2002 | Petrie et al. |
| 2002/0128206 A1 | 9/2002 | Hay et al. |
| 2002/0132977 A1 | 9/2002 | Yuan et al. |
| 2002/0137665 A1 | 9/2002 | Evans et al. |
| 2002/0173618 A1 | 11/2002 | Rivier et al. |
| 2003/0027766 A1 | 2/2003 | Ioannides et al. |
| 2003/0060432 A1 | 3/2003 | Tocque et al. |
| 2003/0074679 A1 | 4/2003 | Schwartz et al. |
| 2003/0083241 A1 | 5/2003 | Young |
| 2003/0105114 A1 | 6/2003 | Carpino et al. |
| 2003/0144331 A1 | 7/2003 | Gudkov et al. |
| 2003/0148948 A1 | 8/2003 | Schwartz et al. |
| 2003/0157717 A1 | 8/2003 | Draghia-Akli |
| 2003/0166138 A1 | 9/2003 | Kinsella et al. |
| 2003/0176318 A1 | 9/2003 | Gudkov et al. |
| 2003/0181367 A1 | 9/2003 | O'Mahony et al. |
| 2003/0186865 A1 | 10/2003 | Acosta et al. |
| 2003/0204063 A1 | 10/2003 | Gravel et al. |
| 2004/0018967 A1 | 1/2004 | Enright et al. |
| 2004/0023887 A1 | 2/2004 | Pillutla et al. |
| 2004/0038901 A1 | 2/2004 | Basler et al. |
| 2004/0038918 A1 | 2/2004 | Draghia-Akli et al. |
| 2004/0058877 A1 | 3/2004 | Hay et al. |
| 2004/0067503 A1 | 4/2004 | Tan et al. |
| 2004/0081652 A1 | 4/2004 | Zack et al. |
| 2004/0091530 A1 | 5/2004 | Am Ende et al. |
| 2004/0106159 A1 | 6/2004 | Kern et al. |
| 2004/0106548 A1 | 6/2004 | Schmidt et al. |
| 2004/0115135 A1 | 6/2004 | Quay |
| 2004/0122062 A1 | 6/2004 | MacLean et al. |
| 2004/0146971 A1 | 7/2004 | Lane et al. |
| 2004/0152708 A1 | 8/2004 | Li et al. |
| 2004/0157834 A1 | 8/2004 | Hay et al. |
| 2004/0170653 A1 | 9/2004 | Stanislawski et al. |
| 2004/0170971 A1 | 9/2004 | Kinzler et al. |
| 2004/0171530 A1 | 9/2004 | Coy et al. |
| 2004/0171809 A1 | 9/2004 | Korsmeyer et al. |
| 2004/0195413 A1 | 10/2004 | Reed et al. |
| 2004/0204358 A1 | 10/2004 | Brown et al. |
| 2004/0208866 A1 | 10/2004 | Jaspers et al. |
| 2004/0228866 A1 | 11/2004 | Lu |
| 2004/0235746 A1 | 11/2004 | Hawiger et al. |
| 2004/0248198 A1 | 12/2004 | Kriwacki et al. |
| 2004/0248788 A1 | 12/2004 | Vickers et al. |
| 2004/0265931 A1 | 12/2004 | Gu et al. |
| 2005/0009739 A1 | 1/2005 | Wang et al. |
| 2005/0013820 A1 | 1/2005 | Holoshitz et al. |
| 2005/0014686 A1 | 1/2005 | Albert et al. |
| 2005/0031549 A1 | 2/2005 | Quay et al. |
| 2005/0037383 A1 | 2/2005 | Taremi et al. |
| 2005/0043231 A1 | 2/2005 | Cutfield et al. |

(56) References Cited

U.S. PATENT DOCUMENTS

| | | |
|---|---|---|
| 2005/0048618 A1 | 3/2005 | Jaspers et al. |
| 2005/0049177 A1 | 3/2005 | Bachovchin et al. |
| 2005/0054581 A1 | 3/2005 | Hay et al. |
| 2005/0059605 A1 | 3/2005 | Peri et al. |
| 2005/0065180 A1 | 3/2005 | Lee |
| 2005/0080007 A1 | 4/2005 | Ghigo et al. |
| 2005/0089511 A1 | 4/2005 | Roth et al. |
| 2005/0119167 A1 | 6/2005 | Abbenante et al. |
| 2005/0137137 A1 | 6/2005 | Lane et al. |
| 2005/0147581 A1 | 7/2005 | Zamiri et al. |
| 2005/0164298 A1 | 7/2005 | Golz et al. |
| 2005/0176075 A1 | 8/2005 | Jones et al. |
| 2005/0203009 A1 | 9/2005 | Pan et al. |
| 2005/0222224 A1 | 10/2005 | Gudkov et al. |
| 2005/0222427 A1 | 10/2005 | Sharpless et al. |
| 2005/0227932 A1 | 10/2005 | Lu et al. |
| 2005/0245438 A1 | 11/2005 | Rivier et al. |
| 2005/0245457 A1 | 11/2005 | Deghenghi |
| 2005/0245764 A1 | 11/2005 | Yamashita et al. |
| 2005/0250680 A1 | 11/2005 | Walensky et al. |
| 2005/0261201 A1 | 11/2005 | Polvino et al. |
| 2005/0277764 A1 | 12/2005 | Boyd et al. |
| 2006/0008848 A1 | 1/2006 | Verdine et al. |
| 2006/0014675 A1 | 1/2006 | Arora et al. |
| 2006/0025344 A1 | 2/2006 | Lange et al. |
| 2006/0058219 A1 | 3/2006 | Miller et al. |
| 2006/0058221 A1 | 3/2006 | Miller et al. |
| 2006/0073518 A1 | 4/2006 | Timmerman et al. |
| 2006/0100143 A1 | 5/2006 | Lu et al. |
| 2006/0111411 A1 | 5/2006 | Cooper et al. |
| 2006/0128615 A1 | 6/2006 | Gaudreau |
| 2006/0142181 A1 | 6/2006 | Miller et al. |
| 2006/0142182 A1 | 6/2006 | Miller et al. |
| 2006/0148715 A1 | 7/2006 | Tweardy |
| 2006/0149039 A1 | 7/2006 | Hunter et al. |
| 2006/0155107 A1 | 7/2006 | Rivier et al. |
| 2006/0189511 A1 | 8/2006 | Koblish et al. |
| 2006/0210641 A1 | 9/2006 | Shalaby |
| 2006/0217296 A1 | 9/2006 | Jansson |
| 2006/0233779 A1 | 10/2006 | Ben-Avraham et al. |
| 2006/0247170 A1 | 11/2006 | Guyon et al. |
| 2006/0293380 A1 | 12/2006 | Nantermet et al. |
| 2007/0004765 A1 | 1/2007 | Graffner-Nordberg et al. |
| 2007/0006332 A1 | 1/2007 | O'Neill |
| 2007/0020620 A1 | 1/2007 | Finn et al. |
| 2007/0025991 A1 | 2/2007 | Pothoulakis et al. |
| 2007/0032417 A1 | 2/2007 | Baell |
| 2007/0037857 A1 | 2/2007 | Perrissoud et al. |
| 2007/0041902 A1 | 2/2007 | Goodman et al. |
| 2007/0060512 A1 | 3/2007 | Sadeghi et al. |
| 2007/0129324 A1 | 6/2007 | Boyd et al. |
| 2007/0161544 A1 | 7/2007 | Wipf et al. |
| 2007/0161551 A1 | 7/2007 | De Luca |
| 2007/0191283 A1 | 8/2007 | Polvino |
| 2007/0197772 A1 | 8/2007 | Arora et al. |
| 2007/0208061 A2 | 9/2007 | Perrissoud et al. |
| 2007/0238662 A1 | 10/2007 | Mintz |
| 2007/0274915 A1 | 11/2007 | Rao et al. |
| 2008/0015265 A1 | 1/2008 | Rubin et al. |
| 2008/0026993 A9 | 1/2008 | Guyon et al. |
| 2008/0032931 A1 | 2/2008 | Steward et al. |
| 2008/0081038 A1 | 4/2008 | Cho et al. |
| 2008/0085279 A1 | 4/2008 | Boyd et al. |
| 2008/0090756 A1 | 4/2008 | Coy et al. |
| 2008/0132485 A1 | 6/2008 | Wang et al. |
| 2008/0161426 A1 | 7/2008 | Gudkov et al. |
| 2008/0167222 A1 | 7/2008 | Lussier et al. |
| 2008/0171700 A1 | 7/2008 | Nilsson et al. |
| 2008/0194553 A1 | 8/2008 | Gillessen et al. |
| 2008/0194672 A1 | 8/2008 | Hoveyda et al. |
| 2008/0213175 A1 | 9/2008 | Kolb et al. |
| 2008/0234183 A1 | 9/2008 | Hallbrink et al. |
| 2008/0242598 A1 | 10/2008 | Fairlie et al. |
| 2008/0250515 A1 | 10/2008 | Reed |
| 2008/0260638 A1 | 10/2008 | Rivier et al. |
| 2008/0260820 A1 | 10/2008 | Borrelly et al. |
| 2008/0261873 A1 | 10/2008 | Geesaman |
| 2008/0262200 A1 | 10/2008 | Nash |
| 2008/0299040 A1 | 12/2008 | Rivier et al. |
| 2008/0300193 A1 | 12/2008 | Ahn et al. |
| 2008/0300194 A1 | 12/2008 | Mann et al. |
| 2008/0305490 A1 | 12/2008 | Burrell et al. |
| 2008/0311608 A1 | 12/2008 | Tocque et al. |
| 2009/0011985 A1 | 1/2009 | Abribat et al. |
| 2009/0047711 A1 | 2/2009 | Nash |
| 2009/0054331 A1 | 2/2009 | Chen et al. |
| 2009/0069245 A1 | 3/2009 | Bowers et al. |
| 2009/0081168 A1 | 3/2009 | Sheppard et al. |
| 2009/0088383 A1 | 4/2009 | Abribat et al. |
| 2009/0088553 A1 | 4/2009 | Nash |
| 2009/0131478 A1 | 5/2009 | Dong et al. |
| 2009/0149630 A1 | 6/2009 | Walensky et al. |
| 2009/0156483 A1 | 6/2009 | Dong et al. |
| 2009/0156795 A1 | 6/2009 | Jaspers et al. |
| 2009/0170757 A1 | 7/2009 | Fraser et al. |
| 2009/0175821 A1 | 7/2009 | Bridon et al. |
| 2009/0176964 A1 | 7/2009 | Walensky et al. |
| 2009/0198050 A1 | 8/2009 | Marsault et al. |
| 2009/0221512 A1 | 9/2009 | Acosta et al. |
| 2009/0221689 A1 | 9/2009 | Marsault et al. |
| 2009/0240027 A1 | 9/2009 | Marsault et al. |
| 2009/0253623 A1 | 10/2009 | Abribat et al. |
| 2009/0275511 A1 | 11/2009 | Dong |
| 2009/0275519 A1 | 11/2009 | Nash et al. |
| 2009/0275648 A1 | 11/2009 | Fraser et al. |
| 2009/0305300 A1 | 12/2009 | Larsen |
| 2009/0311174 A1 | 12/2009 | Allen |
| 2009/0326192 A1 | 12/2009 | Nash et al. |
| 2009/0326193 A1 | 12/2009 | Maggio et al. |
| 2010/0010065 A1 | 1/2010 | Smith |
| 2010/0081611 A1 | 4/2010 | Bradner et al. |
| 2010/0087366 A1 | 4/2010 | Abribat et al. |
| 2010/0087381 A1 | 4/2010 | Polvino |
| 2010/0093057 A1 | 4/2010 | Beattie et al. |
| 2010/0093086 A1 | 4/2010 | Lin et al. |
| 2010/0152114 A1 | 6/2010 | Schally et al. |
| 2010/0158923 A1 | 6/2010 | Morimoto et al. |
| 2010/0168388 A1 | 7/2010 | Bernal et al. |
| 2010/0179168 A1 | 7/2010 | Blaney et al. |
| 2010/0184628 A1 | 7/2010 | Nash |
| 2010/0184645 A1 | 7/2010 | Verdine et al. |
| 2010/0204118 A1 | 8/2010 | Bevec |
| 2010/0210515 A1 | 8/2010 | Nash et al. |
| 2010/0216688 A1 | 8/2010 | Nash et al. |
| 2010/0234563 A1 | 9/2010 | Arora et al. |
| 2010/0239589 A1 | 9/2010 | Woods et al. |
| 2010/0267636 A1 | 10/2010 | Marsolais |
| 2010/0273704 A1 | 10/2010 | Korsmeyer et al. |
| 2010/0286362 A1 | 11/2010 | Boyd et al. |
| 2010/0298201 A1 | 11/2010 | Nash et al. |
| 2010/0298393 A1 | 11/2010 | Vanderklish et al. |
| 2010/0303791 A1 | 12/2010 | Francis et al. |
| 2010/0303794 A1 | 12/2010 | Francis et al. |
| 2010/0323964 A1 | 12/2010 | Vitali et al. |
| 2010/0331343 A1 | 12/2010 | Perrissoud et al. |
| 2011/0020435 A1 | 1/2011 | Maggio |
| 2011/0021529 A1 | 1/2011 | Lain et al. |
| 2011/0028753 A1 | 2/2011 | Verdine et al. |
| 2011/0046043 A1 | 2/2011 | Wang et al. |
| 2011/0065915 A1 | 3/2011 | Malcolmson et al. |
| 2011/0097389 A1 | 4/2011 | Sobol et al. |
| 2011/0105389 A1 | 5/2011 | Hoveyda et al. |
| 2011/0105390 A1 | 5/2011 | Lussier et al. |
| 2011/0130331 A1 | 6/2011 | Guyon et al. |
| 2011/0143992 A1 | 6/2011 | Taub et al. |
| 2011/0144303 A1 | 6/2011 | Nash et al. |
| 2011/0144306 A1 | 6/2011 | Verdine et al. |
| 2011/0151480 A1 | 6/2011 | Sheppard et al. |
| 2011/0158973 A1 | 6/2011 | Madec et al. |
| 2011/0160135 A1 | 6/2011 | Johnstone et al. |
| 2011/0165137 A1 | 7/2011 | Madec et al. |
| 2011/0166063 A1 | 7/2011 | Bossard et al. |
| 2011/0171191 A1 | 7/2011 | Johnstone et al. |
| 2011/0183917 A1 | 7/2011 | Lu et al. |

(56) References Cited

U.S. PATENT DOCUMENTS

| | | |
|---|---|---|
| 2011/0195080 A1 | 8/2011 | Haffer et al. |
| 2011/0218155 A1 | 9/2011 | Walensky et al. |
| 2011/0223149 A1 | 9/2011 | Nash et al. |
| 2011/0230415 A1 | 9/2011 | Berlanga et al. |
| 2011/0243845 A1 | 10/2011 | Goodman et al. |
| 2011/0245159 A1 | 10/2011 | Hoveyda et al. |
| 2011/0245175 A1 | 10/2011 | Arora et al. |
| 2011/0245459 A1 | 10/2011 | Marsault et al. |
| 2011/0245477 A1 | 10/2011 | Hoveyda et al. |
| 2011/0250685 A1 | 10/2011 | Nash |
| 2011/0251252 A1 | 10/2011 | Wang et al. |
| 2011/0263815 A1 | 10/2011 | Nash |
| 2011/0269683 A1 | 11/2011 | Rivier et al. |
| 2011/0313167 A1 | 12/2011 | Doemling |
| 2012/0004174 A1 | 1/2012 | Abribat et al. |
| 2012/0010157 A1 | 1/2012 | Polvino et al. |
| 2012/0040889 A1 | 2/2012 | Nash et al. |
| 2012/0052548 A1 | 3/2012 | Steward et al. |
| 2012/0077745 A1 | 3/2012 | Polvino |
| 2012/0082636 A1 | 4/2012 | Walensky et al. |
| 2012/0083494 A1 | 4/2012 | Aicher et al. |
| 2012/0101047 A1 | 4/2012 | Nash et al. |
| 2012/0115783 A1 | 5/2012 | Nash et al. |
| 2012/0115793 A1 | 5/2012 | Nash et al. |
| 2012/0156197 A1 | 6/2012 | Errico et al. |
| 2012/0165566 A1 | 6/2012 | Marsault et al. |
| 2012/0172311 A1 | 7/2012 | Nash et al. |
| 2012/0178700 A1 | 7/2012 | Nash et al. |
| 2012/0226066 A1 | 9/2012 | Marsault et al. |
| 2012/0226067 A1 | 9/2012 | Marsault et al. |
| 2012/0226072 A1 | 9/2012 | Marsault et al. |
| 2012/0238507 A1 | 9/2012 | Fairlie et al. |
| 2012/0264674 A1 | 10/2012 | Nash et al. |
| 2012/0264738 A1 | 10/2012 | Sugimoto et al. |
| 2012/0270800 A1 | 10/2012 | Verdine et al. |
| 2012/0283269 A1 | 11/2012 | Blagosklonny et al. |
| 2012/0328692 A1 | 12/2012 | Lu et al. |
| 2013/0005943 A1 | 1/2013 | Arora et al. |
| 2013/0023646 A1 | 1/2013 | Nash et al. |
| 2013/0039851 A1 | 2/2013 | Maggio |
| 2013/0072439 A1 | 3/2013 | Nash et al. |
| 2013/0123196 A1 | 5/2013 | Arora et al. |
| 2013/0177979 A1 | 7/2013 | Turkson |
| 2013/0210743 A1 | 8/2013 | Guerlavais et al. |
| 2013/0211046 A1 | 8/2013 | Verdine et al. |
| 2013/0274205 A1 | 10/2013 | Guerlavais et al. |
| 2013/0330421 A1 | 12/2013 | Marine |
| 2014/0005118 A1 | 1/2014 | Verdine et al. |
| 2014/0011979 A1 | 1/2014 | Verdine et al. |
| 2014/0018302 A1 | 1/2014 | Walensky et al. |
| 2014/0051828 A1 | 2/2014 | Arora et al. |
| 2014/0128581 A1 | 5/2014 | Darlak et al. |
| 2014/0162339 A1 | 6/2014 | Verdine et al. |
| 2014/0235549 A1 | 8/2014 | Moellering et al. |
| 2014/0256912 A1 | 9/2014 | Moellering et al. |
| 2014/0296160 A1 | 10/2014 | Walensky et al. |
| 2014/0323701 A1 | 10/2014 | Nash et al. |
| 2014/0378390 A1 | 12/2014 | Guerlavais et al. |
| 2015/0038430 A1 | 2/2015 | Nash et al. |
| 2015/0051155 A1 | 2/2015 | Guerlavais et al. |
| 2015/0056612 A1 | 2/2015 | Shen et al. |
| 2015/0119551 A1 | 4/2015 | Bernal et al. |
| 2015/0157603 A1 | 6/2015 | Higgins et al. |
| 2015/0183825 A1 | 7/2015 | Guerlavais et al. |
| 2015/0225471 A1 | 8/2015 | Liang et al. |
| 2015/0239937 A1 | 8/2015 | Verdine et al. |
| 2015/0284437 A1 | 10/2015 | Verdine et al. |
| 2015/0285810 A1 | 10/2015 | Lu et al. |
| 2015/0376227 A1 | 12/2015 | Verdine et al. |
| 2016/0024153 A1 | 1/2016 | Verdine et al. |
| 2016/0031936 A1 | 2/2016 | Nash |
| 2016/0038498 A1 | 2/2016 | Bussey et al. |
| 2016/0052970 A1 | 2/2016 | Guerlavais et al. |
| 2016/0068573 A1 | 3/2016 | Nash et al. |
| 2016/0095896 A1 | 4/2016 | Nash |
| 2016/0096873 A1 | 4/2016 | Nash et al. |
| 2016/0101145 A1 | 4/2016 | Annis et al. |
| 2016/0108089 A1 | 4/2016 | Nash et al. |
| 2016/0115204 A1 | 4/2016 | Nash et al. |
| 2016/0137710 A1 | 5/2016 | Kawahata et al. |
| 2016/0193283 A1 | 7/2016 | Chen et al. |
| 2016/0250278 A1 | 9/2016 | Nash et al. |
| 2016/0251399 A1 | 9/2016 | Nash et al. |
| 2016/0287569 A1 | 10/2016 | Caenepeel et al. |
| 2016/0289274 A1 | 10/2016 | Nash |
| 2016/0304564 A1 | 10/2016 | Nash |
| 2016/0333049 A1 | 11/2016 | Chen et al. |
| 2016/0339023 A1 | 11/2016 | Li et al. |
| 2017/0002042 A1 | 1/2017 | Annis et al. |

FOREIGN PATENT DOCUMENTS

| | | |
|---|---|---|
| CN | 1583730 A | 2/2005 |
| CN | 1906209 A | 1/2007 |
| CN | 101636407 A | 1/2010 |
| CN | 102223891 A | 10/2011 |
| CN | 102399283 A | 4/2012 |
| CN | 102399284 A | 4/2012 |
| CZ | 9700369 A3 | 9/1998 |
| EP | 0467699 A2 | 1/1992 |
| EP | 0467699 A3 | 2/1993 |
| EP | 0528312 A2 | 2/1993 |
| EP | 0552417 A1 | 7/1993 |
| EP | 0352014 B1 | 3/1994 |
| EP | 0729972 A1 | 9/1996 |
| EP | 0643726 B1 | 8/1999 |
| EP | 0977580 B1 | 4/2003 |
| EP | 1321474 A1 | 6/2003 |
| EP | 1452868 A2 | 9/2004 |
| EP | 1541692 A1 | 6/2005 |
| EP | 1602663 A1 | 12/2005 |
| EP | 1609802 A1 | 12/2005 |
| EP | 1243923 B1 | 3/2006 |
| EP | 1180016 B1 | 9/2006 |
| EP | 0958305 B1 | 6/2008 |
| EP | 2091552 A2 | 8/2009 |
| EP | 2100901 A1 | 9/2009 |
| EP | 2310407 A2 | 4/2011 |
| EP | 1597585 B1 | 6/2011 |
| EP | 2377849 A2 | 10/2011 |
| EP | 2637680 A2 | 9/2013 |
| EP | 3027212 A1 | 6/2016 |
| EP | 2474624 B1 | 8/2016 |
| EP | 3059322 A1 | 8/2016 |
| EP | 2474625 B1 | 11/2016 |
| EP | 2245464 B1 | 12/2016 |
| JP | 2002524391 A | 8/2002 |
| JP | 2008501623 A | 1/2008 |
| JP | 2008096423 A | 4/2008 |
| JP | 2010120881 A | 6/2010 |
| JP | 2010519318 A | 6/2010 |
| WO | WO-8909233 A1 | 10/1989 |
| WO | WO-8912675 A1 | 12/1989 |
| WO | WO-9206998 A1 | 4/1992 |
| WO | WO-9213878 A2 | 8/1992 |
| WO | WO-9301203 A1 | 1/1993 |
| WO | WO-9307170 A1 | 4/1993 |
| WO | WO-9422910 A1 | 10/1994 |
| WO | WO-9425482 A1 | 11/1994 |
| WO | WO-9500534 A1 | 1/1995 |
| WO | WO-9522546 A1 | 8/1995 |
| WO | WO-9602642 A1 | 2/1996 |
| WO | WO-9620951 A1 | 7/1996 |
| WO | WO-9628449 A1 | 9/1996 |
| WO | WO-9632126 A1 | 10/1996 |
| WO | WO-9634878 A1 | 11/1996 |
| WO | WO-9700267 A1 | 1/1997 |
| WO | WO-9713537 A1 | 4/1997 |
| WO | WO-9714794 A1 | 4/1997 |
| WO | WO-9726002 A1 | 7/1997 |
| WO | WO-9730072 A1 | 8/1997 |
| WO | WO-9737705 A1 | 10/1997 |
| WO | WO-9801467 A2 | 1/1998 |
| WO | WO-9817625 A1 | 4/1998 |

(56) References Cited

FOREIGN PATENT DOCUMENTS

| | | |
|---|---|---|
| WO | WO-9846631 A1 | 10/1998 |
| WO | WO-9847525 A1 | 10/1998 |
| WO | WO-9914259 A1 | 3/1999 |
| WO | WO-9934833 A1 | 7/1999 |
| WO | WO-9934850 A1 | 7/1999 |
| WO | WO-9963929 A2 | 12/1999 |
| WO | WO-0006187 A2 | 2/2000 |
| WO | WO-0006187 A3 | 5/2000 |
| WO | WO-02064790 A2 | 8/2002 |
| WO | WO-02070547 A1 | 9/2002 |
| WO | WO-02072597 A2 | 9/2002 |
| WO | WO-02064790 A3 | 5/2003 |
| WO | WO-03054000 A1 | 7/2003 |
| WO | WO-03059933 A2 | 7/2003 |
| WO | WO-03070892 A2 | 8/2003 |
| WO | WO-03102538 A2 | 12/2003 |
| WO | WO-03106491 A2 | 12/2003 |
| WO | WO-03059933 A3 | 1/2004 |
| WO | WO-2004026896 A2 | 4/2004 |
| WO | WO-2004037754 A2 | 5/2004 |
| WO | WO-2004041275 A1 | 5/2004 |
| WO | WO-2004058804 A1 | 7/2004 |
| WO | WO-2004077062 A2 | 9/2004 |
| WO | WO-2004037754 A3 | 10/2004 |
| WO | WO-03070892 A3 | 11/2004 |
| WO | WO-03106491 A3 | 12/2004 |
| WO | WO-2004077062 A3 | 1/2005 |
| WO | WO-2005007675 A2 | 1/2005 |
| WO | WO-2004077062 B1 | 2/2005 |
| WO | WO-2005012335 A1 | 2/2005 |
| WO | WO-2005035568 A1 | 4/2005 |
| WO | WO-2005040202 A2 | 5/2005 |
| WO | WO-2005044839 A2 | 5/2005 |
| WO | WO-2005040202 A3 | 6/2005 |
| WO | WO-2005007675 A3 | 7/2005 |
| WO | WO-2005044839 A3 | 7/2005 |
| WO | WO-2005074521 A2 | 8/2005 |
| WO | WO-2005085457 A2 | 9/2005 |
| WO | WO-2005090388 A1 | 9/2005 |
| WO | WO-2005097173 A2 | 10/2005 |
| WO | WO-2005118620 A2 | 12/2005 |
| WO | WO-2005118625 A1 | 12/2005 |
| WO | WO-2005118634 A2 | 12/2005 |
| WO | WO-2006009645 A1 | 1/2006 |
| WO | WO-2006009674 A1 | 1/2006 |
| WO | WO-2006042408 A1 | 4/2006 |
| WO | WO-2005118634 A3 | 5/2006 |
| WO | WO-2005118620 A3 | 6/2006 |
| WO | WO-2006078161 A1 | 7/2006 |
| WO | WO-2006103666 A2 | 10/2006 |
| WO | WO-2006137974 A2 | 12/2006 |
| WO | WO-2006103666 A3 | 3/2007 |
| WO | WO-2007141533 A2 | 12/2007 |
| WO | WO-2008013454 A2 | 1/2008 |
| WO | WO-2008014216 A1 | 1/2008 |
| WO | WO-2008045238 A2 | 4/2008 |
| WO | WO-2008061192 A2 | 5/2008 |
| WO | WO-2008074895 A1 | 6/2008 |
| WO | WO-2008076904 A1 | 6/2008 |
| WO | WO-2007141533 A3 | 7/2008 |
| WO | WO-2008061192 A3 | 7/2008 |
| WO | WO-2008092281 A1 | 8/2008 |
| WO | WO-2008095063 A1 | 8/2008 |
| WO | WO-2008104000 A2 | 8/2008 |
| WO | WO-2008106507 A2 | 9/2008 |
| WO | WO-2008121767 A2 | 10/2008 |
| WO | WO-2008130464 A1 | 10/2008 |
| WO | WO-2008137633 A2 | 11/2008 |
| WO | WO-2008121767 A3 | 1/2009 |
| WO | WO-2009009727 A2 | 1/2009 |
| WO | WO-2009031916 A1 | 3/2009 |
| WO | WO-2009033667 A2 | 3/2009 |
| WO | WO-2009033668 A2 | 3/2009 |
| WO | WO-2009042237 A2 | 4/2009 |
| WO | WO-2009009727 A3 | 5/2009 |
| WO | WO-2009089004 A1 | 7/2009 |
| WO | WO-2009033667 A3 | 8/2009 |
| WO | WO-2009033668 A3 | 8/2009 |
| WO | WO-2009099677 A2 | 8/2009 |
| WO | WO-2009110952 A2 | 9/2009 |
| WO | WO-2009126292 A2 | 10/2009 |
| WO | WO-2009129311 A2 | 10/2009 |
| WO | WO-2009137532 A1 | 11/2009 |
| WO | WO 2009/149339 * 12/2009 |  |
| WO | WO-2009149214 A2 | 12/2009 |
| WO | WO-2009149339 A2 | 12/2009 |
| WO | WO-2010011313 A2 | 1/2010 |
| WO | WO-2010013011 A1 | 2/2010 |
| WO | WO-2010033617 A2 | 3/2010 |
| WO | WO-2010033879 A2 | 3/2010 |
| WO | WO-2010034026 A1 | 3/2010 |
| WO | WO-2010034028 A1 | 3/2010 |
| WO | WO-2010034029 A1 | 3/2010 |
| WO | WO-2010034031 A1 | 3/2010 |
| WO | WO-2010034032 A2 | 3/2010 |
| WO | WO-2010034034 A1 | 3/2010 |
| WO | WO-2010058819 A1 | 5/2010 |
| WO | WO-2010060112 A1 | 5/2010 |
| WO | WO-2010065572 A1 | 6/2010 |
| WO | WO-2010068684 A2 | 6/2010 |
| WO | WO-2009129311 A3 | 7/2010 |
| WO | WO-2010083347 A2 | 7/2010 |
| WO | WO-2010083501 A2 | 7/2010 |
| WO | WO-2010100351 A1 | 9/2010 |
| WO | WO-2010107485 A1 | 9/2010 |
| WO | WO-2010132580 A2 | 11/2010 |
| WO | WO-2010011313 A3 | 12/2010 |
| WO | WO-2011005219 A1 | 1/2011 |
| WO | WO-2011008260 A2 | 1/2011 |
| WO | WO-2011008260 A3 | 3/2011 |
| WO | WO-2011023677 A1 | 3/2011 |
| WO | WO-2011038049 A1 | 3/2011 |
| WO | WO-2011047215 A1 | 4/2011 |
| WO | WO-2011060049 A2 | 5/2011 |
| WO | WO-2011061139 A1 | 5/2011 |
| WO | WO-2011076786 A1 | 6/2011 |
| WO | WO-2011090297 A2 | 7/2011 |
| WO | WO-2011101297 A1 | 8/2011 |
| WO | WO-2011106650 A2 | 9/2011 |
| WO | WO-2011133948 A2 | 10/2011 |
| WO | WO-2011143208 A1 | 11/2011 |
| WO | WO-2011143209 A1 | 11/2011 |
| WO | WO-2011153491 A2 | 12/2011 |
| WO | WO-2011159917 A2 | 12/2011 |
| WO | WO-2011161699 A2 | 12/2011 |
| WO | WO-2011162968 A1 | 12/2011 |
| WO | WO-2011163012 A2 | 12/2011 |
| WO | WO-2011133948 A3 | 1/2012 |
| WO | WO-2012012352 A2 | 1/2012 |
| WO | WO-2012016186 A1 | 2/2012 |
| WO | WO-2012021874 A1 | 2/2012 |
| WO | WO-2012021875 A1 | 2/2012 |
| WO | WO-2012021876 A2 | 2/2012 |
| WO | WO-2012033525 A2 | 3/2012 |
| WO | WO-2012034954 A1 | 3/2012 |
| WO | WO-2012037519 A2 | 3/2012 |
| WO | WO-2012038307 A1 | 3/2012 |
| WO | WO-2012040459 A2 | 3/2012 |
| WO | WO-2011153491 A3 | 4/2012 |
| WO | WO-2012045018 A1 | 4/2012 |
| WO | WO-2012047587 A2 | 4/2012 |
| WO | WO-2012051405 A1 | 4/2012 |
| WO | WO-2012059696 A1 | 5/2012 |
| WO | WO-2012065022 A2 | 5/2012 |
| WO | WO-2012065181 A2 | 5/2012 |
| WO | WO-2012066095 A1 | 5/2012 |
| WO | WO-2012040459 A3 | 6/2012 |
| WO | WO-2012076513 A1 | 6/2012 |
| WO | WO-2012080376 A1 | 6/2012 |
| WO | WO-2012080389 A1 | 6/2012 |
| WO | WO-2012083078 A2 | 6/2012 |
| WO | WO-2012083181 A1 | 6/2012 |
| WO | WO-2011159917 A3 | 7/2012 |
| WO | WO-2012094755 A1 | 7/2012 |

(56) References Cited

FOREIGN PATENT DOCUMENTS

| | | |
|---|---|---|
| WO | WO-2012037519 A3 | 8/2012 |
| WO | WO-2012121057 A1 | 9/2012 |
| WO | WO-2012122059 A1 | 9/2012 |
| WO | WO-2012149563 A1 | 11/2012 |
| WO | WO-2012173846 A2 | 12/2012 |
| WO | WO-2012174423 A1 | 12/2012 |
| WO | WO-2012175962 A1 | 12/2012 |
| WO | WO-2013033645 A1 | 3/2013 |
| WO | WO-2013036208 A1 | 3/2013 |
| WO | WO-2013049250 A1 | 4/2013 |
| WO | WO-2013059525 A1 | 4/2013 |
| WO | WO-2013059530 A2 | 4/2013 |
| WO | WO-2013123266 A1 | 8/2013 |
| WO | WO-2013123267 A1 | 8/2013 |
| WO | WO-2014052647 A2 | 4/2014 |
| WO | WO-2014055564 A1 | 4/2014 |
| WO | WO-2014071241 A1 | 5/2014 |
| WO | WO-2014138429 A2 | 9/2014 |
| WO | WO-2015157508 A1 | 10/2015 |
| WO | WO-2015198266 A1 | 12/2015 |
| WO | WO-2016049355 A1 | 3/2016 |
| WO | WO-2016049359 A1 | 3/2016 |
| WO | WO-2016154058 A1 | 9/2016 |

OTHER PUBLICATIONS

Belokon et al., Improved procedures for the synthesis of (S)-21N-(N'-benzyl-prolypaminolbenzophenone (BPB) and Ni(II) complexes of Schiffs bases derived from BPB and amino acids. Tetrahedron: Asymmetry. 1998;9:4249-52.
Blangetti et al., Suzuki-miyaura cross-coupling in acylation reactions, scope and recent developments.Molecules. Jan. 17, 2013;18(1):1188-213. doi:10.3390/molecules18011188.
Chittenden, et al. A conserved domain in Bak, distinct from BH1 and BH2, mediates cell death and protein binding functions. EMBO J. Nov. 15, 1995;14(22):5589-96.
Co-pending U.S. Appl. No. 13/655,442, filed Oct. 18, 2010.
Co-pending U.S. Appl. No. 15/201,235, filed Jul. 1, 2016.
Co-pending U.S. Appl. No. 15/229,517, filed Aug. 5, 2016.
Co-pending U.S. Appl. No. 15/233,796, filed Aug. 10, 2016.
Co-pending U.S. Appl. No. 15/240,505, filed Aug. 18, 2016.
Co-pending U.S. Appl. No. 15/256,130, filed Sep. 2, 2016.
Co-pending U.S. Appl. No. 15/257,807, filed Sep. 6, 2016.
Co-pending U.S. Appl. No. 15/259,947, filed Sep. 8, 2016.
Co-pending U.S. Appl. No. 15/332,492, filed Oct. 24, 2016.
Edlund, et al. Data-driven unbiased curation of the TP53 tumor suppressor gene mutation database and validation by ultradeep sequencing of human tumors. PNAS Early Edition, pp. 1-20.
Guerlavais, et al. Advancements in Stapled Peptide Drug Discovery & Development. Annual Reports in Medicinal Chemistry, vol. 49 49 (2014): 331-345.
Henchey, et al. High specificity in protein recognition by hydrogen-bond-surrogate α-helices: selective inhibition of the p53/MDM2 complex. Chembiochem. Oct. 18, 2010;11(15):2104-7. doi: 10.1002/cbic.201000378.
Kinage, et al. Highly regio-selective synthesis of beta-amino alcohol by reaction with aniline and propylene carbonate in self solvent systems over large pore zeolite catalyst. Green and Sustainable Chem. Aug. 2011;1: 76-84.
Kosir, et al. Breast Cancer. Available at https://www.merckmanuals.com/home/women-s-health-issues/breast-disorders/breast-cancer. Accessed on Jun. 29, 2016.
Lee, et al. Novel pyrrolopyrimidine-based α-helix mimetics: cell-permeable inhibitors of protein-protein interactions. J Am Chem Soc. Feb. 2, 2011;133(4):676-9. doi: 10.1021/ja108230s.
Li, et at. Molecular-targeted agents combination therapy for cancer: Developments and potentials. International Journal of Cancer 134.6 (2014): 1257-1269.
Moellering et al., Abstract 69. Computational modeling and molecular optimization of stabilized alpha-helical peptides targeting NOTCH-CSL transcriptional complexes. Nov. 2010; 8(7):30. DOI: 10.1016/S1359-6349(10)71774-2. Abstract Only, European Journal of Cancer Supplements, 2010, 8(7).
Moellering et al., Computational modeling and molecular optimization of stabilized alphahelical peptides targeting NOTCH-CSL transcriptional complexes. European Journal of Cancer Supplements Nov. 2010; 8(7):30. DOI: 10.1016/S1359-6349(10)71774-2. Abstract 69.
Muppidi et al., Conjugation of spermine enhances cellular uptake of the stapled peptide-based inhibitors of p53-Mdm2 interaction. Bioorg Med Chem Lett. Dec. 15, 2011;21(24):7412-5. doi: 10.1016/j.bmcl.2011.10.009. Epub Oct. 12, 2011.
Mustapa, et al. Synthesis of a cyclic peptide containing norlanthionine: effect of the thioether bridge on peptide conformation. J Org Chem. Oct. 17, 2003;68(21):8193-8.
Myriem, V. One pot iodination click reaction: A Convenient Preparation of 5-Iodo-1,4-disubstituted-1,2,3-triazole. Date unknown.
Wikipedia the Free Encyclopedia. Willgerodt Rearrangement. Available at https://en.wikipedia.org/wiki/Willgerodt_rearrangement. Accessed on Feb. 12, 2013.
Yang, et al. Calculation of protein conformation from circular dichroism. Methods Enzymol. 1986;130:208-69.
Yu, et al. Synthesis of macrocyclic natural products by catalyst-controlled stereoselective ring-closing metathesis. Nature. Nov. 2, 2011;479(7371):88-93. doi: 10.1038/nature10563.
Zhang, et al. Targeting p53-MDM2-MDMX loop for cancer therapy. Subcell Biochem. 2014;85:281-319. doi: 10.1007/978-94-017-9211-0_16.
Notice of allowance dated Jan. 7, 2015 for U.S. Appl. No. 13/370,057.
Notice of allowance dated Jan. 27, 2014 for U.S. Appl. No. 12/233,555.
Notice of allowance dated Mar. 22, 2010 for U.S. Appl. No. 11/148,976.
Notice of allowance dated May 4, 2004 for U.S. Appl. No. 09/574,086.
Notice of allowance dated May 8, 2012 for U.S. Appl. No. 12/182,673.
Notice of allowance dated May 18, 2016 for U.S. Appl. No. 14/070,354.
Notice of allowance dated Jun. 1, 2016 for U.S. Appl. No. 14/070,354.
Notice of allowance dated Jul. 7, 2009 for U.S. Appl. No. 10/981,873.
Notice of allowance dated Jul. 18, 2016 for U.S. Appl. No. 14/498,063.
Notice of allowance dated Jul. 19, 2016 for U.S. Appl. No. 14/068,844.
Notice of allowance dated Jul. 21, 2016 for U.S. Appl. No. 14/677,679.
Notice of allowance dated Jul. 28, 2014 for U.S. Appl. No. 13/680,905.
Notice of allowance dated Jul. 28, 2016 for U.S. Appl. No. 14/498,063.
Notice of allowance dated Oct. 14, 2016 for U.S. Appl. No. 14/027,064.
Notice of allowance dated Oct. 23, 2015 for U.S. Appl. No. 13/252,751.
Office action dated Jan. 14, 2016 for U.S. Appl. No. 14/027,064.
Office action dated Jan. 29, 2016 for U.S. Appl. No. 14/483,905.
Office action dated Feb. 4, 2014 for U.S. Appl. No. 13/370,057.
Office action dated Feb. 5, 2016 for U.S. Appl. No. 14/068,844.
Office action dated Feb. 24, 2015 for U.S. Appl. No. 13/252,751.
Office action dated Mar. 18, 2013 for U.S. Appl. No. 13/097,930.
Office action dated Mar. 18, 2015 for U.S. Appl. No. 14/070,367.
Office action dated Apr. 26, 2012 for U.S. Appl. No. 13/097,930.
Office action dated Apr. 28, 2016 for U.S. Appl. No. 14/677,679.
Office action dated May 10, 2010 for U.S. Appl. No. 11/957,325.
Office action dated May 19, 2010 for U.S. Appl. No. 12/140,241.
Office action dated May 24, 2016 for U.S. Appl. No. 14/027,064.
Office action dated Jun. 6, 2016for U.S. Appl. No. 14/608,641.
Office action dated Jun. 18, 2015 for U.S. Appl. No. 14/068,844.
Office action dated Jun. 28, 2013 for U.S. Appl. No. 13/370,057.

(56) References Cited

OTHER PUBLICATIONS

Office action dated Jul. 30, 2013 for U.S. Appl. No. 13/097,930.
Office action dated Aug. 10, 2009 for U.S. Appl. No. 11/957,325.
Office action dated Aug. 11, 2009 for U.S. Appl. No. 12/140,241.
Office action dated Aug. 19, 2010 for U.S. Appl. No. 12/037,041.
Office action dated Oct. 4, 2016 for U.S. Appl. No. 14/864,801.
Office action dated Oct. 15, 2012 for U.S. Appl. No. 13/097,930.
Office action dated Oct. 24, 2016 for U.S. Appl. No. 14/718,288.
Office action dated Oct. 27, 2016 for U.S. Appl. No. 14/864,687.
Office action dated Oct. 31, 2014 for U.S. Appl. No. 13/370,057.
Office action dated Nov. 16, 2015 for U.S. Appl. No. 14/070,354.
Office action dated Dec. 7, 2015 for U.S. Appl. No. 14/677,679.
Office action dated Dec. 13, 2012 for U.S. Appl. No. 12/690,076.
Office action dated Dec. 23, 2015 for U.S. Appl. No. 14/498,063.
Website: http://www.onelook.com/?w=span&ls=a&loc=home_ac_span, 1 page, Retrieved on Jan. 23, 2016.
Patgiri et al. An orthosteric inhibitor of the Ras-Sos interaction. Nat Chem Bio 7:585-587 (2011).
Peryshkov, et al. Z-Selective olefin metathesis reactions promoted by tungsten oxo alkylidene complexes. J Am Chem Soc. Dec. 28, 2011;133(51):20754-7. doi: 10.1021/ja210349m. Epub Nov. 30, 2011.
Rivlin, et al. Mutations in the p53 Tumor Suppressor Gene: Important Milestones at the Various Steps of Tumorigenesis. Genes & Cancer 2011, 2:466. Originally published online May 18, 2011.
Rytting, et al. Overview of Leukemia. Available at http://www.merckmanuals.com/home/blood-disorders/leukemias/overview-of%20leukemia?qt=Leukemia&%2520alt=sh. Accessed on Jun. 29, 2016.
Sawyer, et al. Macrocyclic a-Helical Peptide Drug Discovery. Macrocycles in Drug Discovery 40 (2014): 339-366.
Solution phase synthesis from http://www.combichemistry.com/solution_phase_synthesis.html. p. 1. Accessed Aug. 6, 2009.
Thundimadathil, New Reactions with Click Chemistry. An R&D Magazine Webcast. Oct. 10, 2012. Available at http://www.rdmag.com/articles/2012/10/new-reactions-click-chemistry.
Wang, et al. BID: a novel BH3 domain-only death agonist. Genes Dev. Nov. 15, 1996;10(22):2859-69.
Weaver et al.,Transition metal-catalyzed decarboxylative allylation and benzylation reactions.Chemical Rev. Mar. 9, 2011;111(3):1846-913.
Adhikary et al., Transcriptional regulation and transformation by Myc proteins. Nat Rev Mol Cell Biol. Aug. 2005;6(8):635-45.
Agola et al., Rab GTPases as regulators of endocytosis, targets of disease and therapeutic opportunities. Clin Genet. Oct. 2011; 80(4): 305-318.
Aman et al., cDNA cloning and characterization of the human interleukin 13 receptor alpha chain. J Biol Chem. Nov. 15, 1996;271(46):29265-70.
Andrews et al. Forming Stable Helical Peptide Using Natural and Artificial Amino Acids. Tetrahedron. 1999;55:11711-11743.
Andrews et al., Kinetic analysis of the interleukin-13 receptor complex. J Biol Chem. Nov. 29, 2002;277(48):46073-8. Epub Sep. 26, 2002.
Angel & Karin, "The Role of Jun, Fos and the AP-1 Complex in Cell-proliferation and Transformation," Biochim. Biophys. Acta 1072:129-157 (1991).
Angell, et al. Peptidomimetics via copper-catalyzed azide-alkyne cycloadditions. Chem Soc Rev. Oct. 2007;36(10):1674-89.
Angell, et al. Ring closure to beta-turn mimics via copper-catalyzed azide/alkyne cycloadditions. J Org Chem. Nov. 11, 2005;70(23):9595-8.
Annis, et al. ALIS: An Affinity Selection-Mass Spectrometry System for the Discovery and Characterization of Protein-Ligand Interactions. In: Wanner, K. And Höfner, G. eds. Mass Spectrometry in Medicinal Chemistry. Wiley-VCH; 2007:121-156.
Annis, et al. ALIS: An affinity selection-mass spectrometry system for the discovery and characterization of protein-ligand Interactions. Mass Spectrometry in Medicinal Chemistry: Applications in Drug Discovery (2007): 121-156.

Armstrong et al., X = Y-ZH Systems as potential 1,3-dipoles. 5. Intramolecular cycloadditions of imines of a-amino acid esters. Tetrahedron. 1985;41(17):3547-58.
Arosio, et al. Click chemistry to functionalise peptidomimetics. Tetrahedron Letters. 2006; 47:3697-3700.
Artavanis-Tsakonas et al., Notch signaling: cell fate control and signal integration in development. Science. Apr. 30, 1999;284(5415):770-6.
Attisano et al., TGFbeta and Wnt pathway cross-talk. Cancer Metastasis Rev. Jan.-Jun. 2004;23(1-2):53-61.
Austin et al., "A Template for Stabilization of a Peptide α-Helix: Synthesis and Evaluation of Conformational Effects by Circular Dichroism and NMR," J. Am. Chem. Soc. 119:6461-6472 (1997).
Babcock, Proteins, radicals, isotopes, and mutants in photosynthetic oxygen evolution. Proc Natl Acad Sci U S A. Dec. 1, 1993;90(23)10893-5.
Babine et aL, Molecular Recognition of Proteinminus signLigand Complexes: Applications to Drug Design. Chem Rev. Aug. 5, 1997;97(5):1359-1472.
Badyal, et al. A Simple Method for the Quantitative Analysis of Resin Bound Thiol Groups. Tetrahedron Lett. 2001; 42:8531-33.
Baek, et al. Structure of the stapled p53 peptide bound to Mdm2. J Am Chem Soc. Jan. 11, 2012;134(1):103-6. doi: 10.1021/ja2090367. Epub Dec. 14, 2011.
Baell, J.B. Prospects for Targeting the Bcl-2 Family of Proteins to Develop Novel cytotoxic drugs. Biochem Pharmacol. Sep. 2002;64(5-6):851-63.
Bakhshi, et al. Cloning the chromosomal breakpoint of t(14;18) human lymphomas: clustering around JH on chromosome 14 and near a transcriptional unit on 18. Cell. Jul. 1985;41(3):899-906.
Banerjee et aL, Structure of a DNA glycosylase searching for lesions. Science. Feb. 24, 2006 ;311(5764):1153-7.
Banerjee et al., Structure of a repair enzyme interrogating undamaged DNA elucidates recognition of damaged DNA. Nature. Mar. 31, 2005;434(7033):612-8.
Banerji et al. Synthesis of Cyclic β-Turn Mimics from L-Pro-Phe/Phe-L-Pro Derived Di- and Tripeptides via Ring Closing Metathesis: The Role of Chirality of the Phe Residue During Cyclization. Tetrahedron Lett. 2002; 43:6473-6477.
Bang et al., Total chemical synthesis of crambin. J Am Chem Soc. Feb. 11, 2004;126(5):1377-83.
Barandon et al., Reduction of infarct size and prevention of cardiac rupture in transgenic mice overexpressing FrzA. Circulation. Nov. 4, 2003;108(18):2282-9. Epub Oct. 27, 2003.
Barker, et al. Cyclic RGD peptide analogues as antiplatelet antithrombotics. J Med Chem. May 29, 1992;35(11):2040-8. (Abstract only).
Barker et al., Mining the Wnt pathway for cancer therapeutics. Nat Rev Drug Discov. Dec. 2006;5(12):997-1014.
Belokon et al., Chiral Complexes of Ni(II), Cu(II) and Cu(I) as Reagents, Catalysts and Receptors for Asymmetric Synthesis and Chiral Recognition of Amino Acids. Pure & Appl Chem. 1992;64(12):1917-24.
Belokon, et al. Improved procedures for the synthesis of (S)-2-[N-(N'- benzylprolyl)amino]benzophenone (BPB) and Ni(II) complexes of Schiff's bases derived from BPB and amino acids. Tetrahedron: Asymmetry, vol. 9, Issue 23, Dec. 11, 1998, pp. 4249-4252.
Belokon, Y. N., et al., "Halo-substituted (S)-N-(2-benzoylphenyl)-1-benzylpyrolidine-2 carboxamides as new chiral auxiliaries for the asymmetric synthesis of (S)-a-amino acids,"Russian Chemical Bulletin, International Edition, 51 (8): 1593-1599 (2002.
Bennett, et al. Regulation of osteoblastogenesis and bone mass by Wntl Ob. Proc Natl Acad Sci U S A. Mar. 1, 2005;102(9):3324-9.. Epub Feb. 22, 2005.
Berendsen et al., A glimpse of the Holy Grail? Science. Oct. 23, 1998;282(5389):642-3.
Berge et al. Pharmaceutical Salts. Journal of Pharmaceutical Sciences 66(1):1-19 (Jan. 1977).
Bernal, et al. A stapled p53 helix overcomes HDMX-mediated suppression of p53. Cancer Cell. Nov. 16, 2010;18(5):411-22. doi: 10.1016/j.ccr.2010.10.024.

(56) References Cited

OTHER PUBLICATIONS

Bernal, et al. Reactivation of the p53 tumor suppressor pathway by a stapled p53 peptide. J Am Chem Soc. Mar. 7, 2007;129(9):2456-7.
Biagini et al., Cross-metathesis of Unsaturated a-amino Acid Derivatives. J Chem Soc Perkin Trans. 1998;1:2485-99.
Bierzynski et al. A salt bridge stabilizes the helix formed by isolated C-Peptide of RNase A. PNAS USA. 1982;79:2470-2474.
Blackwell, et al. Highly Efficient Synthesis of Covalently Cross-Linked Peptide Helices by Ring-Closing Metathesis. Angewandte Chemie International Edition. 1998; 37(23):3281-3284.
Blackwell, et al. Ring-closing metathesis of olefinic peptides: design, synthesis, and structural characterization of macrocyclic helical peptides. J Org Chem. Aug. 10, 2001;66(16):5291-302.
Blundell et al., Atomic positions in rhombohedral 2-zinc insulin crystals. Nature. Jun. 25, 1971;231(5304):506-11.
Bock, et al. 1,2,3-Triazoles as peptide bond isosteres: synthesis and biological evaluation of cyclotetrapeptide mimics. Org Biomol Chem. Mar. 21, 2007;5(6):971-5.
Bode et al., Chemoselective amide ligations by decarboxylative condensations of N-alkylhydroxylamines and alpha-ketoacids. Angew Chem Int Ed Engl. Feb. 13, 2006;45(8):1248-52.
Boguslavsky, et al. Effect of peptide conformation on membrane permeability. J Pept Res. Jun. 2003;61(6):287-97.
Bossy-Wetzel, et al. Assays for cytochrome c release from mitochondria during apoptosis. Methods Enzymol. 2000;322:235-42.
Bossy-Wetzel, et al. Detection of apoptosis by annexin V labeling. Methods Enzymol. 2000;322:15-8.
Bottger, et al. Molecular characterization of the hdm2-p53 interaction. J Mol Biol. Jun. 27, 1997;269(5):744-56.
Boyden et al., High bone density due to a mutation in LDL-receptor-related protein 5. N Engl J Med. May 16, 2002;346(20):1513-21.
Bracken et al. Synthesis and nuclear magnetic resonance structure determination of an alpha-helical, bicyclic, lactam-bridged hexapeptide. JACS. 1994;116:6431-6432.
Bradley et al., Limits of cooperativity in a structurally modular protein: response of the Notch ankyrin domain to analogous alanine substitutions in each repeat. J Mol Biol. Nov. 22, 2002;324(2):373-86.
Brandt et al., Dimeric fragment of the insulin receptor alpha-subunit binds insulin with full holoreceptor affinity. J Biol Chem. Apr. 13, 2001;276(15):12378-84. Epub Jan. 12, 2001.
Bray, Notch signalling: a simple pathway becomes complex. Nat Rev Mol Cell Biol. Sep. 2006;7(9):678-89.
Brea, et al. Synthesis of omega-(hetero)arylalkynylated alpha-amino acid by Sonogashira-type reactions in aqueous media. J Org Chem. Sep. 29, 2006;71(20):7870-3.
Brou et al., A novel proteolytic cleavage involved in Notch signaling: the role of the disintegrin-metalloprotease TACE. Mol Cell. Feb. 2000;5(2):207-16.
Brown, et al. A spiroligomer α-helix mimic that binds HDM2, penetrates human cells and stabilizes HDM2 in cell culture. PLoS One. 2012;7(10):e45948. doi: 10.1371/journal.pone.0045948. Epub Oct. 18, 2012.
Brown, et al. Stapled peptides with improved potency and specificity that activate p53. ACS Chem Biol. Mar. 15, 2013;8(3):506-12. doi: 10.1021/cb3005148. Epub Dec. 18, 2012.
Brubaker et al., Solution structure of the interacting domains of the Mad-Sin3 complex: implications for recruitment of a chromatin-modifying complex. Cell. Nov. 10, 2000;103(4):655-65.
Brunel, et al. Synthesis of constrained helical peptides by thioether ligation: application to analogs of gp41. Chem Commun (Camb). May 28, 2005;(20):2552-4. Epub Mar. 11, 2005.
Brusselle et al., Allergen-induced airway inflammation and bronchial responsiveness in wild-type and interleukin-4-deficient mice. Am J Respir Cell Mol Biol. Mar. 1995;12(3):254.-9.
Burfield & Smithers, "Desiccant Efficiency in Solvent Drying. 3. Dipolar Aprotic Solvents," J. Org. Chem. 43(20):3966-3968 (1978).
Burger et aL, Synthesis of a-(trifluoromethyl)-substituted a-amino acids. Part 7. An efficient synthesis for a-trifluoromethyl-substituted w-carboxy a-amino acids. Chemiker-Zeitung. 1990;114(3):101-04. German.
Burrage, et al. Biomimetic synthesis of lantibiotics. Chemistry. Apr. 14, 2000;6(8):1455-66.
Cabezas & Satterthwait, "The Hydrogen Bond Mimic Approach: Solid-phase Synthesis of a Peptide Stabilized as an α-Helix with a Hydrazone Link," J. Am. Chem. Soc. 121:3862-3875 (1999).
Campbell, et al. N-alkylated oligoamide alpha-helical proteomimetics. Org Biomol Chem. May 21, 2010;8(10):2344-51. doi: 10.1039/c001164a. Epub Mar. 18, 2010.
Cantel, et al. Synthesis and Conformational Analysis of a Cyclic Peptide Obtained via i to i+4 Intramolecular Side-Chain to Side-Chain Azide-Alkyne 1,3-Dipolar Cycloaddition. JOC Featured Article. Published on the web May 20, 2008.
Caricasole et al., The Wnt pathway, cell-cycle activation and beta-amyloid: novel therapeutic strategies in Alzheimer's disease? Trends Pharmacol Sci. May 2003;24(5):233-8.
Cariello, et al. Resolution of a missense mutant in human genomic DNA by denaturing gradient gel electrophoresis and direct sequencing using in vitro DNA amplification: HPRT Munich. Am J Hum Genet. May 1988;42(5):726-34.
Carillo et al., The Multiple Sequence Alignment Problem in Biology. SIAM J Applied Math. 1988;48:1073-82.
Carlson et al., Specificity landscapes of DNA binding molecules elucidate biological function. Proc Natl Acad Sci USA. Mar. 9, 2010;107(10):4544-9. doi: 10.1073/pnas.0914023107. Epub Feb. 22, 2010.
CAS Registry No. 2176-37-6, STN Entry Date Nov. 16, 1984.
CAS Registry No. 2408-85-7, STN Entry Date Nov. 16, 1984.
CAS Registry No. 4727-05-3, STN Entry Date Nov. 16, 1984.
CAS Registry No. 561321-72-0, STN Entry Date Aug. 6, 2003.
CAS Registry No. 721918-14-5, STN Entry Date Aug. 4, 2004.
Chakrabartty et al., "Helix Capping Propensities in Peptides Parallel Those in Proteins," Proc. Nat'l Acad. Sci. USA 90:11332-11336 (1993).
Chang, et al. Stapled α-helical peptide drug development: a potent dual inhibitor of MDM2 and MDMX for p53-dependent cancer therapy. Proc Natl Acad Sci U S A. Sep. 3, 2013;110(36):E3445-54. doi: 10.1073/pnas.1303002110. Epub Aug. 14, 2013.
Chapman et al., "A Highly Stable Short α-Helix Constrained by a Main-chain Hydrogen-bond Surrogate," J. Am. Chem. Soc. 126:12252-12253 (2004).
Chapman, et al. Optimized synthesis of hydrogen-bond surrogate helices: surprising effects of microwave heating on the activity of Grubbs catalysts. Org Lett. Dec. 7, 2006;8(25):5825-8.
Chapman, et al. Trapping a folding intermediate of the alpha-helix: stabilization of the pi-helix. Biochemistry. Apr. 8, 2008;47(14):4189-95. doi: 10.1021/bi800136m. Epub Mar. 13, 2008.
Chen et al., Determination of the helix and beta form of proteins in aqueous solution by circular dichroism. Biochemistry. Jul. 30, 1974;13(16):3350-9.
Chen, et al. Determination of the Secondary Structures of Proteins by Circular Dichroism and Optical Rotatory Dispersion. Biochemistry. 1972; 11(22):4120-4131.
Chen et al., Small molecule-mediated disruption of Wnt-dependent signaling in tissue regeneration and cancer. Nat Chem Biol. Feb. 2009(2):100-7. Epub Jan. 4, 2009.
Chen et al., "Structure of the DNA-binding Domains from NFAT, Fos and Jun Bound Specifically to DNA," Nature 392:42-48 (1998).
Cheng et al., Emerging role of RAB GTPases in cancer and human disease. Cancer Res. Apr. 1, 2005;65(7):2516-9.
Cheng et al., The RAB25 small GTPase determines aggressiveness of ovarian and breast cancers. Nat Med. Nov. 2004;10(11):1251-6. Epub Oct. 24, 2004.
Cheon et al., beta-Catenin stabilization dysregulates mesenchymal cell proliferation, motility, and invasiveness and causes aggressive fibromatosis and hyperplastic cutaneous wounds. Proc Natl Acad Sci U S A. May 14, 2002;99(10):6973-8. Epub Apr. 30, 2002.
Chia et al., Emerging roles for Rab family GTPases in human cancer. Biochim Biophys Acta. Apr. 2009;1795(2):110-6.

(56) References Cited

OTHER PUBLICATIONS

Chiaramonte et al., Studies of murine schistosomiasis reveal interleukin-13 blockade as a treatment for established and progressive liver fibrosis. Hepatolgy. Aug. 2001;34(2):273-82.
Chin & Schepartz, "Design and Evolution of a Miniature Bcl-2 Binding Protein," Angew. Chem. Int. Ed. 40(20):3806-3809 (2001).
Chin et al., "Circular Dichroism Spectra of Short, Fixed-nucleus Alanine Helices," Proc. Nat'l Acad. Sci. USA 99(24):15416-15421 (2002).
Chène et al., "Study of the Cytotoxic Effect of a Peptidic Inhibitor of the p53-hdm2 Interaction in Tumor Cells," FEBS Lett. 529:293-297 (2002).
Chène, P., "Inhibiting the p53-MDM2 Interaction: An Important Target for Cancer Therapy," Nat Rev. Cancer 3:102-109 (2003).
Choi, et al. Application of azide-alkyne cycloaddition 'click chemistry' for the synthesis of Grb2 SH2 domain-binding macrocycles. Bioorg Med Chem Lett. Oct. 15, 2006;16(20):5265-9.
Christodoulides et al., WNT1OB mutations in human obesity. Diabetologia. Apr. 2006;49(4):678-84. Epub Feb. 14, 2006.
Chu, et al. Peptide-formation on cysteine-containing peptide scaffolds. Orig Life Evol Biosph. Oct. 1999;29(5):441-9.
Clark et al., Supramolecular Design by Covalent Capture. Design of a Peptide Cylinder via Hydrogen-Bond-Promoted Intermolecular Olefin Metathesis. J Am Chem Soc. 1995;117:12364-65.
Cleary, et al. Nucleotide sequence of a t(14;18) chromosomal breakpoint in follicular lymphoma and demonstration of a breakpoint-cluster region near a transcriptionally active locus on chromosome 18. Proc Natl Acad Sci U S A. Nov. 1985;82(21):7439-43.
Clevers, Wnt/beta-catenin signaling in development and disease. Cell. Nov. 3, 2006;127(3):469-80.
Cline, et al. Effects of As(III) binding on alpha-helical structure. J Am Chem Soc. Mar. 12, 2003;125(10):2923-9.
Cohn et al., Cutting Edge: IL-4-independent induction of airway hyperresponsiveness by Th2, but not Thl, cells. J Immunol. Oct. 15, 1998;161(8):3813-6.
Colacino, et al. Evaluation of the anti-influenza virus activities of 1,3,4-thiadiazol-2-ylcyanamide (LY217896) and its sodium salt. Antimicrob Agents Chemother. Nov. 1990;34(11):2156-63.
Colaluca et al., NUMB controls p53 tumour suppressor activity. Nature. Jan. 3, 2008;451(7174):76-80. doi: 10.1038/nature06412.
Cole et al., Transcription-independent functions of MYC: regulation of translation and DNA replication. Nat Rev Mol Cell Biol. Oct. 2008;9(10):810-5. Epub Aug. 13, 2008.
Cong et al., A protein knockdown strategy to study the function of beta-catenin in tumorigenesis. BMC Mol Biol. Sep. 29, 2003;4:10.
Co-pending U.S. Appl. No. 13/494,846, filed Jun. 12, 2012.
Co-pending U.S. Appl. No. 15/093,335, filed Apr. 7, 2016.
Co-pending U.S. Appl. No. 15/093,373, filed Apr. 7, 2016.
Co-pending U.S. Appl. No. 15/093,426, filed Apr. 7, 2016.
Co-pending U.S. Appl. No. 15/093,869, filed Apr. 8, 2016.
Cory et al., "The Bcl-2 Family: Roles in Cell Survival and Oncogenesis," Oncogene 22:8590-8607 (2003).
Cossu et al., Wnt signaling and the activation of myogenesis in mammals EMBO J. Dec. 15, 1999;18(24):6867-72.
Cotton, et al. Reactivity of cytosine and thymine in single-base-pair mismatches with hydroxylamine and osmium tetroxide and its application to the study of mutations. Proc Natl Acad Sci U S A. Jun. 1988;85(12):4397-401.
Cox et al., Insulin receptor expression by human prostate cancers. Prostate. Jan. 1, 2009;69(1):33-40. doi: 10.1002/pros.20852.
Cummings, et al. Disrupting protein-protein interactions with non-peptidic, small molecule alpha-helix mimetics. Curr Opin Chem Biol. Jun. 2010;14(3):341-6. doi: 10.1016/j.cbpa.2010.04.001. Epub Apr. 27, 2010.
Cusack et al. 2,4,6-Tri-isopropylbenzenesulphonyl Hydrazide: A convenient source of Di-lmide. Tetrahedron. 1976;32:2157-2162.
Danial, et al. Cell death: critical control points. Cell. 2004; 116:204-219.

Danial et al., Dual role of proapoptotic BAD in insulin secretion and beta cell survival. Nat Med. Feb. 2008;14(2):144-53. doi: 10.1038/nm1717. Epub Jan. 27, 2008.
Darnell, Transcription factors as targets for cancer therapy. Nat Rev Cancer. Oct. 2002;2(10):740-9.
Daugherty & Gellman, "A Fluorescence Assay for Leucine Zipper Dimerization: Avoiding Unintended Consequences of Fluorophore Attachment," J. Am. Chem. Soc. 121:4325-4333 (1999).
David et al., Expressed protein ligation. Method and applications. Eur J Biochem. Feb. 2004;271(4):663-77.
Dawson et al., Synthesis of proteins by native chemical ligation. Science. Nov. 4, 1994;266(5186):776-9.
De Guzman et al., Structural basis for cooperative transcription factor binding to the CBP coactivator. J Mol Biol. Feb. 3, 2006;355(5):1005-13. Epub Oct. 5, 2005.
De La O et al., Notch and Kras reprogram pancreatic acinar cells to ductal intraepithelial neoplasia. Proc Natl Acad Sci U S A. Dec. 2, 2008;105(48):18907-12. doi: 10.1073/pnas.0810111105. Epub Nov. 21, 2008.
De Meyts et al., Insulin interactions with its receptors: experimental evidence for negative cooperativity. Biochem Biophys Res Commun. Nov. 1, 1973;55(1):154-61.
De Meyts, The structural basis of insulin and insulin-like growth factor-I receptor binding and negative co-operativity, and its relevance to mitogenic versus metabolic signalling. Diabetologia. Sep. 1994;37 Suppl 2:S135-48.
De Strooper et al., A presenilin-l-dependent gamma-secretase-like protease mediates release of Notch intracellular domain. Nature. Apr. 8, 1999;398(6727):518-22.
Debinski et al., Retargeting interleukin 13 for radioimmunodetection and radioimmunotherapy of human high-grade gliomas. Clin Cancer Res. Oct. 1999;5(10 Suppl):3143s-3147s.
Definition of Analog from http://cancerweb.ncl.ac.uk/cgi-bin/omd?query=analog. pp. 1-5. Accessed Jul. 7, 2005.
Degterev et al., "Identification of Small-molecule Inhibitors of Interaction between the BH3 Domain and Bcl-xL," Nature Cell Biol. 3:173-182 (2001).
Del Bianco et al., Mutational and energetic studies of Notch 1 transcription complexes. J Mol Biol. Feb. 8, 2008;376(1):131-40. Epub Nov. 28, 2007.
Deng, et al. Cross-Coupling Reaction of lodo-1,2,3-triazoles Catalyzed by Palladium. Synthesis 2005(16): 2730-2738.
Denmark et al., Cyclopropanation with Diazomethane and Bis(oxazoline)palladium(II) Complexes. J Org Chem. May 16, 1997;62(10):3375-3389.
Designing Custom Peptide. from SIGMA Genosys, pp. 1-2. Accessed Dec. 16, 2004.
Devereux et al., A comprehensive set of sequence analysis programs for the VAX. Nucleic Acids Res. Jan. 11, 1984;12(1 Pt 1):387-95.
Dimartino et al. Solid-phase synthesis of hydrogen-bond surrogate-derived alpha-helices. Org Lett. Jun. 9, 2005;7(12):2389-92.
Dombroski et al., Isolation of an active human transposable element. Science. Dec. 20, 1991;254(5039):1805-8.
Doron, et al. Probiotics: their role in the treatment and prevention of disease. Expert Rev Anti Infect Ther. Apr. 2006;4(2):261-75.
Dovey et al., Functional gamma-secretase inhibitors reduce beta-amyloid peptide levels in brain. J Neurochem. Jan. 2001;76(1):173-81.
Duronio, Insulin receptor is phosphorylated in response to treatment of HepG2 cells with insulin-like growth factor I. Biochem J. Aug. 15, 1990;270(1):27-32.
Eckert & Kim, "Mechanisms of Viral Membrane Fusion and Its Inhibition," Annu. Rev. Biochem. 70:777-810 (2001).
Eglen et al., The use of AlphaScreen technology in HTS: current status. Curr Chem Genomics. Feb. 25, 2008;1:2-10. doi: 10.2174/1875397300801010002.
Eisenmesser et al., Solution structure of interleukin-13 and insights into receptor engagement. J Mol Biol. Jun. 29, 2001;310(1):231-41.
Ellis et al., Design, synthesis, and evaluation of a new generation of modular nucleophilic glycine equivalents for the efficient synthesis of sterically constrained alpha-amino acids. J Org Chem. Oct. 27, 2006;71(22):8572-8.

(56) References Cited

OTHER PUBLICATIONS

Ellisen et al., TAN-1, the human homolog of the *Drosophila* notch gene, is broken by chromosomal translocations in T lymphoblastic neoplasms. Cell. Aug. 23, 1991;66(4):649-61.
Ellman. Tissue sulfhydryl groups. Arch Biochem Biophys. May 1959;82(1):70-7.
Erlanson, et al. Facile synthesis of cyclic peptides containing di-, tri-, tetra-, and Pentasulfides. Tetrahedron Letters. 1998; 39(38):6799-6802.
Erlanson et al., The leucine zipper domain controls the orientation of AP-1 in the NFAT.AP-1.DNA complex. Chem Biol. Dec. 1996;3(12):981-91.
European office action dated Aug. 20, 2012 for EP Application No. 09730445.5.
European search report and search opinion dated May 6, 2011 for Application No. 10195495.6.
European search report and search opinion dated May 9, 2011 for Application No. 10195490.7.
European search report dated Nov. 7, 2008 for Application No. 8016651.5.
European search report dated Aug. 22, 2008 for Application No. 4811198.3.
Evans et al., The Rise of Azide—Alkyne 1,3-Dipolar 'Click' Cycloaddition and its Application to Polymer Science and Surface Modification. Australian Journal of Chemistry. 2007;60:384-95.
Extended European Search Report for EP 09800675.2, dated Dec. 6, 2012.
Extended European Search Report for EP 10800148.8, dated Oct. 16, 2013 (H0824.70004EP00).
Extended European Search Report for EP 12159110.1, dated Jul. 20, 2012.
Extended European Search Report (Replacement Copy) for EP 12159110 1, dated Sep. 27, 2012.
Favrin et al., Two-state folding over a weak free-energy barrier. Biophys J. Sep. 2003;85(3):1457-65.
Felix et al., "Synthesis, Biological Activity and Conformational Analysis of Cyclic GRF Analogs," Int. J. Pep. Protein Res. 32:441-454 (1988).
Feng et al. Solid-phase SN2 macrocyclization reactions to form beta-turn mimics. Org Lett. Jul. 15, 1999;1(1):121-4.
Fields, et al. Chapter 3 in Synthetic Peptides: A User's Guide. Grant W.H. Freeman & Co. New York, NY. 1992. p. 77.
Fieser, et al. Fieser and Fieser's Reagents for Organic Synthesis. John Wiley and Sons. 1994.
File Hcaplus on STN. AN No. 1986:572318. Armstrong et al. X=Y-ZH systems as potential 1,3-dipoles. 5. Intramolecular imines of α-amino acid esters. Tetrahedron. 1985; 41(17):3547-58. Abstract only. Abstract date Nov. 1986.
File Hcaplus on STN. AN No. 1990:532752. Burger et al. Synthesis of a-(trifluoromethyl)-substituted a-amino acids. Part 7. An efficient synthesis for a-trifluoromethyl-substituted w-carboxy a-amino acids. Chemiker-Zeitung (1990), 114(3), 101-4. Abstract only, date Oct. 1990.
File Hcaplus on STN. AN No. 1979:168009. Greenlee et al. A general synthesis of alpha-vinyl-alpha-amino acids Tetrahedron Letters (1978), (42), 3999-4002. Abstract date 1984.
Fischback et al., Specific biochemical inactivation of oncogenic Ras proteins by nucleoside diphosphate kinase. Cancer Res. Jul. 15, 2003;63(14):4089-94.
Fischer, et al. Apoptosis-based therapies and drug targets. Cell Death and Differentiation. 2005; 12:942-961.
Fischer et al., The HIV-1 Rev activation domain is a nuclear export signal that accesses an export pathway used by specific cellular RNAs. Cell. Aug. 11, 1995;82(3):475-83.
Fischer, P. Peptide, Peptidomimetic, and Small-molecule Antagonists of the p53-HDM2 Protein-Protein Interaction. Int J Pept Res Ther. Mar. 2006;12(1):3-19. Epub Mar. 15, 2006.
Fisher et al., Myc/Max and other helix-loop-helix/leucine zipper proteins bend DNA toward the minor groove. Proc Natl Acad Sci U S A. Dec. 15, 1992;89(24):11779-83.

Folkers, et al. Methods and principles in medicinal chemistry. Eds. R. Mannhold, H. Kubinyi, and H. Timmerman. Wiley-VCH, 2001.
Formaggio et al., Inversion of 3(10)-helix screw sense in a (D-alpha Me)Leu homo-tetrapeptide induced by a guest D-(alpha Me)Val residue. J Pept Sci. Nov.-Dec. 1995;1(6):396-402.
Friedman-Einat, et al. Target gene identification: target specific transcriptional activation by three murine homeodomain/VP16 hybrid proteins in *Saccharomyces cerevisiae*. J Exp Zool. Feb. 15, 1996;274(3):145-56.
Friedmann et al., RAM-induced allostery facilitates assembly of a notch pathway active transcription complex. J Biol Chem. May 23, 2008;283(21):14781-91. doi: 10.1074/jbc.M709501200. Epub Apr. 1, 2008.
Fromme et al., Structural basis for removal of adenine mispaired with 8-oxoguanine by MutY adenine DNA glycosylase. Nature. Feb. 12, 2004;427(6975):652-6.
Fryer et al., Mastermind mediates chromatin-specific transcription and turnover of the Notch enhancer complex. Genes Dev. Jun. 1, 2002;16(11):1397-411.
Fuchs et al., Socializing with the neighbors: stem cells and their niche. Cell. Mar. 19, 2004;116(6):769-78.
Fulda, et al. Extrinsic versus intrinsic apoptosis pathways in anticancer chemotherapy. Oncogene. Aug. 7, 2006;25(34):4798-811.
Fung et al., Delta-like 4 induces notch signaling in macrophages: implications for inflammation. Circulation. Jun. 12, 2007;115(23):2948-56. Epub May 28, 2007.
Furstner et al., Alkyne Metathesis: Development of a Novel Molybdenum-Based Catalyst System and Its Application to the Total Synthesis of Epothilone A and C. Chem Euro J. 2001;7(24):5299-5317.
Furstner, et al. Mo[N(t-Bu)(AR)]3 Complexes as catalyst precursors: In situ activation and application to metathesis reactions of alkynes and diynes. J Am chem Soc. 1999; 121:9453-54.
Furstner, et al. Nozaki—Hiyama—Kishi reactions catalytic in chromium. J Am Chem Soc. 1996; 118:12349-57.
"Fustero, et al. Asymmetric synthesis of new beta,beta-difluorinated cyclic quaternary alpha-amino acid derivatives. Org Lett. Aug. 31, 2006;8(18):4129-32."
Galande, et al. Thioether side chain cyclization for helical peptide formation: inhibitors of estrogen receptor-coactivator interactions. Journal of Peptide Research. 2004; 63(3): 297-302.
Galande, et al. An effective method of on-resin disulfide bond formation in peptides. J Comb Chem. Mar.-Apr. 2005;7(2):174-7.
Gallivan et al., A neutral, water-soluble olefin metathesis catalyst based on an N-heterocyclic carbene ligand. Tetrahedron Letters. 2005;46:2577-80.
Galluzzi, et al. Guidelines for the use and interpretation of assays for monitoring cell death in higher eukaryotes. Cell Death Differ. Aug. 2009;16(8):1093-107. Epub Apr. 17, 2009.
Gante, Peptidomimetics—Tailored Enzyme Inhibitors. J Angew Chem Int Ed Engl. 1994;33:1699-1720.
García-Echeverría et al., "Discovery of Potent Antagonists of the Interaction between Human Double Minute 2 and Tumor Suppressor p53," J. Med. Chem. 43:3205-3208 (2000).
Garg et al., Mutations in NOTCH1 cause aortic valve disease. Nature. Sep. 8, 2005;437(7056):270-4. Epub Jul. 17, 2005.
Gat et al., De Novo hair follicle morphogenesis and hair tumors in mice expressing a truncated beta-catenin in skin. Cell. Nov. 25, 1998;95(5):605-14.
Gavathiotis et al., BAX activation is initiated at a novel interaction site. Nature. Oct. 23, 2008;455(7216):1076-81.
Geistlinger & Guy, "An Inhibitor of the Interaction of Thyroid Hormone Receptor β and Glucocorticoid Interacting Protein 1," J. Am. Chem. Soc. 123:1525-1526 (2001).
Gemperli et al., "Paralog-selective Ligands for Bcl-2 Proteins," J. Am. Chem. Soc. 127:1596-1597 (2005).
Gentle et al., Direct production of proteins with N-terminal cysteine for site-specific conjugation. Bioconjug Chem. May-Jun. 2004;15(3):658-63.
Gerber-Lemaire et al., Glycosylation pathways as drug targets for cancer: glycosidase inhibitors. Mini Rev Med Chem. Sep. 2006;6(9):1043-52.

(56) References Cited

OTHER PUBLICATIONS

Ghadiri & Choi, "Secondary Structure Nucleation in Peptides. Transition Metal Ion Stabilized α-Helices," J. Am. Chem. Soc. 112:1630-1632 (1990).
Giannis et aL, Peptidomimetics for Receptor Ligands—Discovery, Development, and Medical Perspectives. Angew Chem Int Ed Engl. 1993;32:1244-67.
Glover & Harrison, "Crystal Structure of the Heterodimeric bZIP Transcription Factor c-Fos-c-Jun Bound to DNA," Nature 373:257-261 (1995).
Goncalves, et al. On-resin cyclization of peptide ligands of the Vascular Endothelial Growth Factor Receptor 1 by copper(I)-catalyzed 1,3-dipolar azide-alkyne cycloaddition. Bioorg Med Chem Lett. Oct. 15, 2007;17(20):5590-4.
Gong et al., LDL receptor-related protein 5 (LRP5) affects bone accrual and eye development. Cell. Nov. 16, 2011;107(4):513-23.
Goodson et al., Potential Growth Antagonists. I. Hydantoins and Disubstituted Glycines. J Org Chem. 1960;25:1920-24.
Gorlich et al., Transport between the cell nucleus and the cytoplasm. Annu Rev Cell Dev Biol. 1999;15:607-60.
Goun et al., Molecular transporters: synthesis of oligoguanidinium transporters and their application to drug delivery and real-time imaging. Chembiochem. Oct. 2006;7(10):1497-515.
Greene, et al. Protective Groups in Organic Synthesis, 2nd Ed. John Wiley and Sons. 1991.
Greenfield et al. Computed circular dichroism spectra for the evaluation of protein conformation. Biochemistry. Oct. 8, 1969;(10):4108-4116.
Greenlee et al., A General Synthesis of a-vinyl-a-amino acids. Tetrahedron Letters. 1978;42:3999-40002.
Grossman, et al. Inhibition of oncogenic Wnt signaling through direct targeting of-catenin. Proc. Natl. Acad. Sco. 2012; 109(44):17942-179747.
Grubbs, et al. Ring-Closing Metathesis and Related Processes in Organic Synthesis. Acc. Chem. Res., 1995, 28 (11), pp. 446-452.
Grunig et al., Requirement for IL-13 independently of IL-4 in experimental asthma. Science. Dec. 18, 1998;282(5397):2261-3.
Guinn et al., Synthesis and characterization of polyamides containing unnatural amino acids. Biopolymers. May 1995;35(5):503-12.
Guo et al., Probing the alpha-helical structural stability of stapled p53 peptides: molecular dynamics simulations and analysis. Chem Biol Drug Des. Apr. 2010;75(4):348-59. doi: 10.1111/.1747-0285. 2010.00951.x.
Gupta et al., Long-term effects of tumor necrosis factor-alpha treatment on insulin signaling GUPTA pathway in HepG2 cells and HepG2 cells overexpressing constitutively active Akt/PKB. J Cell Biochem. Feb. 15, 2007;100(3):593-607.
Hanessian, et al. Structure-based design and synthesis of macroheterocyclic peptidomimetic inhibitors of the aspartic protease beta-site amyloid precursor protein cleaving enzyme (BACE). J Med Chem. Jul. 27, 2006;49(15):4544-67.
Hara, S. et al. 'Synthetic studies on halopeptins, anti-inflammatory cyclodepsipeptides', Peptide Science. 2006 (vol. date 2005), 42nd, pp. 39-42.
Harper et al., Efficacy of a bivalent LI virus-like particle vaccine in prevention of infection with human papillomavirus types 16 and 18 in young women: a randomized controlled trial. Lancet. Nov. 13-19, 2004;364(9447):1757-65.
Harris et al., Synthesis of proline-modified analogues of the neuroprotective agent glycyl-1-prolyl-glutamic acid (GPE). Tetrahedron. 2005;61:10018-35.
Harrison, et al. Downsizing human, bacterial, and viral proteins to short water-stable alpha helices that maintain biological potency. Proc Natl Acad Sci U S A. Jun. 29, 2010;107(26):11686-91. doi: 10.1073/pnas.1002498107. Epub Jun. 11, 2010.
Hartmann, A Wnt canon orchestrating osteoblastogenesis. Trends Cell Biol. Mar. 2006;16(3):151-8. Epub Feb. 7, 2006.
Hartmann et al., Dual roles of Wnt signaling during chondrogenesis in the chicken limb. Development. Jul. 2000;127(14):3141-59.
Hase; et al., "1,6-Aminosuberic acid analogs of lysine- and arginine-vasopressin and-vasotocin. Synthesis and biological properties. J Am Chem Soc. May 17, 1972;94(10):3590-600."
Hein, et al. Copper(I)-Catalyzed Cycloaddition of Organic Azides and 1-Iodoalkynes. Angew Chem Int Ed Engl. 2009;48(43):8018-21.
Hellman et al., Electrophoretic mobility shift assay (EMSA) for detecting protein-nucleic acid interactions. Nat Protoc. 2007;2(8):1849-61.
Hemerka, et al. Detection and characterization of influenza A virus PA-PB2 interaction through a bimolecular fluorescence complementation assay. J Virol. Apr. 2009;83(8):3944-55. doi: 10.1128/JVI.02300-08. Epub Feb. 4, 2009.
Henchey et al., Contemporary strategies for the stabilization of peptides in the a-helical conformation. Curr Opin Chem Biol. 2008;12:692-97.
Henchey, et al. Inhibition of Hypoxia Inducible Factor 1-Transcription Coactivator Interaction by a Hydrogen Bond Surrogate α-Helix. J Am Chem Soc. Jan. 27, 2010;132(3):941-3.
Hessa, et al. Recognition of transmembrane helices by the endoplasmic reticulum translocon. Nature. Jan. 27, 2005;433(7024):377-81.
Hilton et al., Notch signaling maintains bone marrow mesenchymal progenitors by suppressing osteoblast differentiation. Nat Med. Mar. 2008;14(3):306-14. doi: 10.1038/nm1716. Epub Feb. 24, 2008.
Hipfner et al., Connecting proliferation and apoptosis in development and disease. Nat Rev Mol Cell Biol. Oct. 2004;5(10):805-15.
Hiroshige, et al. Palladium-mediated macrocyclisations on solid support and its applica-tions to combinatorial synthesis. J. Am. Chem. Soc. 1995; 117:11590-11591.
Hoang et al., Dickkopf 3 inhibits invasion and motility of Saos-2 osteosarcoma cells by modulating the Wnt-beta-catenin pathway. Cancer Res. Apr. 15, 2004;64(8):2734-9.
Holford et al., Adding 'splice' to protein engineering. Structure. Aug. 15, 1998;6(8):951-6.
Horiguchi, et al. Identification and characterization of the ER/lipid droplet-targeting sequence in 17beta-hydroxysteroid dehydrogenase type 11. Arch Biochem Biophys. Nov. 15, 2008;479(2):121-30. doi: 10.1016/j.abb.2008.08.020. Epub Sep. 10, 2008.
Horne, et al. Foldamers with heterogeneous backbones. Acc Chem Res. Oct. 2008;41(10):1399-408. doi: 10.1021/ar800009n. Epub Jul. 1, 2008.
Horne, et al. Heterocyclic peptide backbone modifications in an alpha-helical coiled coil. J Am Chem Soc. Dec. 1, 2004;126(47):15366-7.
Horne, et al. Structural and biological mimicry of protein surface recognition by alpha/beta-peptide foldamers. Proc Natl Acad Sci U S A. Sep. 1, 2009;106(35):14751-6. doi: 10.1073/pnas.0902663106. Epub Aug. 17, 2009.
Hoveyda et al., "Ru Complexes Bearing Bidentate Carbenes: From Innocent Curiosity to Uniquely Effective Catalysts for Olefin Metathesis," Org. Biomolec. Chem. 2:8-23 (2004).
Hu, et al. Efficient p53 activation and apoptosis by simultaneous disruption of binding to MDM2 and MDMX. Cancer Res. Sep. 15, 2007;67(18):8810-7.
Huang et al., How insulin binds: the B-chain alpha-helix contacts the LI beta-helix of the insulin receptor. J Mol Biol. Aug. 6, 2004;341(2):529-50.
Huang et al., Tankyrase inhibition stabilizes axin and antagonizes Wnt signalling. Nature. Oct. 1, 2009;461(7264):614-20. Epub Sep. 16, 2009.
Hunt, S. The Non-Protein Amino Acids. In: Barrett G.C., ed. Chemistry and Biochemistry of the Amino Acids. New York; Chapman and Hall; 1985.
International Preliminary Repoert on Patentability for PCT/US2011/052755, dated Apr. 4, 2013.
International Preliminary Report on Patentability for PCT/US2008/058575 dated Oct. 8, 2009.
International Preliminary Report on Patentability for PCT/US2009/004260 dated Feb. 3, 2011.
International Preliminary Report on Patentability for PCT/US2010/001952 dated Jan. 26, 2012.

(56) References Cited

OTHER PUBLICATIONS

International Preliminary Report on Patentability for PCT/US2012/042738, dated Jan. 3, 2014.
International search report and written opinion dated May 23, 2013 for PCT/US2013/026241.
International search report and written opinion dated May 29, 2013 for PCT/US2013/026238.
International search report and written opinion dated Oct. 12, 2011 for PCT/US2011/047692.
International Search Report and Written Opinion for PCT/US2008/052580, dated May 16, 2008.
International Search Report and Written Opinion for PCT/US2008/058575 dated Nov. 17, 2008.
International Search Report and Written Opinion for PCT/US2009/004260 dated Oct. 15, 2010.
International Search Report and Written Opinion for PCT/US2010/001952 dated Feb. 2, 2011.
International Search Report and Written Opinion for PCT/US2011/052755 dated Apr. 25, 2012.
International Search Report and Written Opinion for PCT/US2012/042738, dated Oct. 18, 2012.
International Search Report and Written Opinion for PCT/US2013/062929, dated Jan. 30, 2014.
International search report dated Nov. 30, 2009 for PCT Application No. US2009/02225.
International search report dated May 18, 2005 for PCT Application No. US2004/38403.
Invitation to Pay Additional Fees for PCT/US2009/004260 dated Mar. 19, 2010.
Invitation to Pay Additional Fees for PCT/US2010/001952 dated Oct. 29, 2010.
Invitation to Pay Additional Fees for PCT/US2011/052755 dated Feb. 16, 2012.
Invitation to Pay Additional Fees for PCT/US2013/062004, dated Jan. 2, 2014.
Isidro-Llobet, et al. Amino acid-protecting groups. Chem Rev. Jun. 2009;109(6):2455-504. doi: 10.1021/cr800323s.
Jackson et al. General approach to the synthesis of short alpha-helical peptides. JACS. 1991;113:9391-9392.
Jamieson et al., Granulocyte-macrophage progenitors as candidate leukemic stem cells in blast-crisis CML. N Engl J Med. Aug. 12, 2004;351(7):657-67.
Jensen et al., Activation of the insulin receptor (IR) by insulin and a synthetic peptide has different effects on gene expression in IR-transfected L6 myoblasts. Biochem J. Jun. 15, 2008;412(3):435-45. doi: 10.1042/BJ20080279.
Ji, et al. In vivo activation of the p53 tumor suppressor pathway by an engineered cyclotide. J Am Chem Soc. Aug. 7, 2013;135(31):11623-33. doi: 10.1021/ja405108p. Epub Jul. 25, 2013.
Jin, et al. Structure-based design, synthesis, and activity of peptide inhibitors of RGS4 GAP activity. Methods Enzymol. 2004;389:266-77.
Jin, et al. Structure-based design, synthesis, and pharmacologic evaluation of peptide RGS4 inhibitors. J Pept Res. Feb. 2004;63(2):141-6.
Joerger, et al. Structural biology of the tumor suppressor p53. Annu Rev Biochem. 2008;77:557-82. doi: 10.1146/annurev.biochem.77.060806.091238.
Johannesson, et al. Vinyl sulfide cyclized analogues of angiotensin II with high affinity and full agonist activity at the AT(1) receptor. J Med Chem. Apr. 25, 2002;45(9):1767-77.
Jordan et al., Wnt4 overexpression disrupts normal testicular vasculature and inhibits testosterone synthesis by repressing steroidogenic factor 1/beta-catenin synergy. Proc Natl Acad Sci U S A. Sep. 16, 2003;100(19):10866-71. Epub Aug. 29, 2003.
Joutel et al., Notch3 mutations in CADASIL, a hereditary adult-onset condition causing stroke and dementia. Nature. Oct. 24, 1996;383(6602):707-10.
Junutula et al., Molecular characterization of Rab11 interactions with members of the family of Rab1 I-interacting proteins. J Biol Chem. Aug. 6, 2004;279(32):33430-7. Epub Jun. 1, 2004.
Kallen, et al. Crystal structures of human MdmX(HdmX) in complex with p53 peptide analogues reveal surprising conformational changes. Journal of Biological Chemistry. Mar. 27, 2009; 284:8812-8821.
Kanan et al. Reaction discovery enabled by DNA-templated synthesis and in vitro selection. Nature. Sep. 30, 2004;431(7008):545-9.
Karle, et al. Structural charateristics of alpha-helical peptide molecules containing Aib residues. Biochemistry. Jul. 24, 1990;29(29):6747-56.
Karle. Flexibility in peptide molecules and restraints imposed by hydrogen bonds, the Aib residue, and core inserts. Biopolymers. 1996;40(1):157-80.
Karwoski et al., Lysinonorleucine cross-link formation in alpha amino heptenoic acid- substituted peptide derivatives. Biopolymers. 1978;17(5):1119-27.
Katoh et al., Cross-talk of WNT and FGF signaling pathways at GSK3beta to regulate beta-catenin and SNAIL signaling cascades. Cancer Biol Ther. Sep. 2006;5(9):1059-64. Epub Sep. 4, 2006.
Katsu et al., The human frizzled-3 (FZD3) gene on chromosome 8p21, a receptor gene for Wnt ligands, is associated with the susceptibility to schizophrenia. Neurosci Lett. Dec. 15, 2003;353(1):53-6.
Kaul & Balaram, "Stereochemical Control of Peptide Folding," Bioorg. Med. Chem. 7:105-117 (1999).
Kawamoto, Targeting the BCL9/B9L binding interaction with beta-catenin as a potential anticancer strategy. PhD Thesis. Jun. 3, 2010. Available at http://deepblue.lib.umich.edu/handle/2027.42/75846 last accessed Apr. 9, 2012. Abstract only. 2 pages.
Kazmaier, Sythesis of Quaternary Amino Acids Containing 13, y- as well as 7,6-Unsaturated Side Chains via Chelate-Enolate Claisen Rearrangement. Tetrahedron Letters. 1996:37(30):5351-4.
Kedrowski, B.L. et al. 'Thiazoline ring formation from 2-methylcysteines and 2-halomethylalanines', Heterocycles. 2002, vol. 58, pp. 601-634.
Kelly-Welch et al, Interleukin-4 and Interleukin-13 Signaling Connections Maps. Science. 2003;300:1527-28.
Kelso et al., "A Cyclic Metallopeptide Induces α Helicity in Short Peptide Fragments of Thermolysin," Angew. Chem. Int. Ed. 42(4):421-424 (2003).
Kelso et al., "α-Turn Mimetics: Short Peptide α-Helices Composed of Cyclic Metallopentapeptide Modules," J. Am. Chem. Soc. 126:4828-4842 (2004).
Kemp et al., "Studies of N-Terminal Templates for α-Helix Formation. Synthesis and Conformational Analysis of (2S,5S,8S,11S)-1-Acetyl-1,4-diaza-3-keto-5-carboxy-10-thiatricyclo[2.8.1.04,8]-tridecane (Ac-Hel1-OH)," J. Org. Chem. 56:6672-6682 (1991).
Kent. Advanced Biology. Oxford University Press. 2000.
Khalil et al., An efficient and high yield method for the N-tert-butoxycarbonyl protection of sterically hindered amino acids. Tetrahedron Lett. 1996;37(20):3441-44.
Kilby et al., "Potent Suppression of HIV-1 Replication in Humans by T-20, a Peptide Inhibitor of gp41-Mediated Virus Entry," Nat. Med. 4(11):1302-1307 (1998).
Kim et al., Introduction of all-hydrocarbon i,i+3 staples into alpha-helices via ring-closing olefin metathesis. Org Lett. Jul. 2, 2010;12(13):3046-9. doi: 10.1021/ol1010449.
Kim et al., Stereochemical effects of all-hydrocarbon tethers in i,i+4 stapled peptides. Bioorg Med Chem Lett. May 1, 2009;19(9):2533-6. Epub Mar. 13, 2009.
Kim et al., Synthesis of all-hydrocarbon stapled a-helical peptides by ring-closing olefin metathesis. Nat Protoc. Jun. 2011;6(6):761-71. doi: 10.1038/nprot.2011.324. Epub May 12, 2011.
Kimmerlin et al., '100 years of peptide synthesis': ligation methods for peptide and protein synthesis with applications to beta-peptide assemblies. J Pept Res. Feb. 2005;65(2):229-60.
Kinzler et al., Identification of FAP locus genes from chromosome 5q21. Science. Aug. 9, 1991;253(5020):661-5.
Kinzler et al., Lessons from hereditary colorectal cancer. Cell. Oct. 18, 1996;87(2):159-70.

(56) References Cited

OTHER PUBLICATIONS

Knackmuss et al., Specific inhibition of interleukin-13 activity by a recombinant human single-chain immunoglobulin domain directed against the IL-13 receptor alphal chain. Biol Chem. Mar. 2007;388(3):325-30.
Kohler et al., DNA specificity enhanced by sequential binding of protein monomers. Proc Natl Acad Sci U S A. Oct. 12, 1999;96(21):11735-9.
Kolb et al., Click Chemistry: Diverse Chemical Function from a Few Good Reactions. Angew Chem Int Ed Engl. Jun. 1, 2001;40(11):2004-2021.
Kondo et al., Frizzled 4 gene (FZD4) mutations in patients with familial exudative vitreoretinopathy with variable expressivity. Br J Ophthalmol. Oct. 2003;87(10):1291-5.
Konishi et al Gamma-secretase inhibitor prevents Notch3 activation and reduces proliferation in human lung cancers. Cancer Res. Sep. 1, 2007;67(17):8051-7.
Korcsmaros et al., Uniformly curated signaling pathways reveal tissue-specific cross-talks and support drug target discovery. Bioinformatics. Aug. 15, 2010;26(16):2042-50. Epub Jun. 11, 2010.
Korinek et al., Depletion of epithelial stem-cell compartments in the small intestine of mice lacking Tcf-4. Nat Genet. Aug. 1998;19(4):379-83.
Kotha et al., Modification of constrained peptides by ring-closing metathesis reaction. Bioorg Med Chem Lett. Jun. 4, 2001;11(11):1421-3.
Kouzarides, Acetylation: a regulatory modification to rival phosphorylation? EMBO J. Mar. 15, 2000;19(6):1176-9.
Kovall et al., Crystal structure of the nuclear effector of Notch signaling, CSL, bound to DNA. EMBO J. Sep. 1, 2004;23(17):3441-51. Epub Aug. 5, 2004.
Kozlovsky et aL, GSK-3 and the neurodevelopmental hypothesis of schizophrenia. Eur Neuropsychopharmacol. Feb. 2002;12(1):13-25.
Kristensen et al., Expression and characterization of a 70-kDa fragment of the insulin receptor that binds insulin. Minimizing ligand binding domain of the insulin receptor. J Biol Chem. Jul. 10, 1998;273(28):17780-6.
Kristensen et al., Functional reconstitution of insulin receptor binding site from non-binding receptor fragments. J Biol Chem. May 24, 2002;277(21):18340-5. Epub Mar. 18, 2002.
Kritzer et al., "Helical β-Peptide Inhibitors of the p53-hDM2 Interaction," J. Am. Chem. Soc. 126:9468-9469 (2004).
Kudaj, et al. An efficient synthesis of optically pure alpha-alkyl-beta-azido- and alpha-alkyl-beta-aminoalanines via ring opening of 3-amino-3-alkyl-2-oxetanones. Tetrahedron Letters. 2007; 48:6794-6797.
Kurose et al., Cross-linking of a B25 azidophenylalanine insulin derivative to the carboxyl-terminal region of the alpha-subunit of the insulin receptor. Identification of a new insulin-binding domain in the insulin receptor. J Biol Chem. Nov. 18, 1994;269(46):29190-7.
Kussie et al, "Structure of the MDM2 Oncoprotein Bound to the p53 Tumor Suppressor Transactivation Domain," Science 274:948-953 (1996).
Kutchukian et al., All-atom model for stabilization of alpha-helical structure in peptides by hydrocarbon staples. J Am Chem Soc. Apr. 8, 2009;131(13):4622-7.
Kutzki et al., "Development of a Potent Bcl-xL Antagonist Based on α-Helix Mimicry," J. Am. Chem. Soc. 124:11838-11839 (2002).
Kwon, et al. Quantitative comparison of the relative cell permeability of cyclic and linear peptides. Chem Biol. Jun. 2007;14(6):671-7.
Lacombe et al. Reduction of olefins on solid support using diimide. Tetrahedron Letters. 1998;39:6785-6786.
Lammi et al., Mutations in AXIN2 cause familial tooth agenesis and predispose to colorectal cancer. Am J Hum Genet. May 2004;74(5):1043-50. Epub Mar. 23, 2004.
Laporte et al., Molecular and structural basis of cytokine receptor pleiotropy in the interleukin-4/13 system. Cell. Jan. 25, 2008;132(2):259-72.
Larock, R.C. Comprehensive Organic Transformations, New York: VCH Publishers; 1989.
Le Geuzennec et al., Molecular characterization of Sin3 PAH-domain interactor specificity and identification of PAH partners. Nucleic Acids Res. 2006;34(14):3929-37. Epub Aug. 12, 2006.
Le Geuzennec et al., Molecular determinants of the interaction of Mad with the PAH2 domain of mSin3. J Biol Chem. Jun. 11, 2004;279(24):25823-9. Epub Mar. 26, 2004.
Leduc et al., Helix-stabilized cyclic peptides as selective inhibitors of steroid receptor-coactivator interactions. Proc Natl Acad Sci USA. 2003;100(20):11273-78.
Lee, et al. A novel BH3 ligand that selectively targets Mcl-1 reveals that apoptosis can proceed without Mcl-1 degradation. J Cell Biol. Jan. 28, 2008;180(2):341-355.
Letai, et al. Distinct BH3 Domains Either Sensitize or Activate Mitochondrial Apoptosis, Serving as Prototype Cancer Therapeutics. Cancer Cell. 2002; 2:183-192.
Lewis et al., Apoptosis in T cell acute lymphoblastic leukemia cells after cell cycle arrest induced by pharmacological inhibition of notch signaling. Chem Biol. Feb. 2007;14(2):209-19.
Li, et al. A convenient preparation of 5-iodo-1,4-disubstituted-1,2,3-triazole: multicomponent one-pot reaction of azide and alkyne mediated by CuI-NBS. J Org Chem. May 2, 2008;73(9):3630-3. doi: 10.1021/jo800035v. Epub Mar. 22, 2008.
Li; et al., "A versatile platform to analyze low-affinity and transient protein-protein interactions in living cells in real time.", 2014, 9(5):, 1946-58.
Li et al., Alagille syndrome is caused by mutations in human Jagged1, which encodes a ligand for Notch1. Nat Genet. Jul. 1997;16(3):243-51.
Li et al., Modulation of Notch signaling by antibodies specific for the extracellular negative regulatory region of NOTCH3. J Biol Chem. Mar. 21, 2008;283(12):8046-54. doi: 10.1074/jbc. M800170200. Epub Jan. 8, 2008.
Li et al., Notch3 signaling promotes the development of pulmonary arterial hypertension. Nat Med. Nov. 2009;15(11):1289-97. doi: 10.1038/nm.2021. Epub Oct. 25, 2009.
Li, et al. Structure-based design of thioether-bridged cyclic phosphopeptides binding to Grb2-SH2 domain. Bioorg Med Chem Lett. Mar. 10, 2003;13(5):895-9.
Li, et al. Systematic mutational analysis of peptide inhibition of the p53-MDM2/MDMX interactions. J Mol Biol. Apr. 30, 2010;398(2):200-13. doi: 10.1016/j.jmb.2010.03.005. Epub Mar. 10, 2010.
Liang et al., Wnt5a inhibits B cell proliferation and functions as a tumor suppressor in hematopoietic tissue. Cancer Cell. Nov. 2003;4(5):349-60.
Lifson & Roig, "On the Theory of Helix-coil Transition in Polypeptides," J. Chem. Phys. 34(6):1963-1974 (1961).
Lindsay et al., Rab coupling protein (RCP), a novel Rab4 and Rab11 effector protein. J Biol Chem. Apr. 5, 2002;277(14):12190-9. Epub Jan. 10, 2002.
Liskamp, et al. Conformationally restricted amino acids and dipeptides, (non)peptidomimetics and secondary structure mimetics. Recl Travl Chim Pays-Bas. 1994; 113:1-19.
Litowski & Hodges, "Designing Heterodimeric Two-stranded α-Helical Coiled-coils: Effects of Hydrophobicity and α-Helical Propensity on Protein Folding, Stability, and Specificity," J. Biol. Chem. 277(40):37272-37279 (2002).
Little et aL, A Mutation in the LDL Receptor-Related Protein 5 Gene Results in the Autosomal Dominant High-Bone-Mass Trait. Am J Hum Genet. 2002;70:11-19.
Liu et al., Chemical Ligation Approach to Form a Peptide Bond between Unprotected Peptide Segments. Concept and Model Study. J Am Chem Soc. 1994;116(10):4149-53.
Liu et al., Targeted degradation of beta-catenin by chimeric F-box fusion proteins. Biochem Biophys Res Commun. Jan. 23, 2004;313(4)1:023-9.
Lo et al., Phosphorylation by the beta-catenin/MAPK complex promotes 14-3-3-mediated nuclear export of TCF/POP-1 in signal-responsive cells in C. elegans. Cell. Apr. 2, 2004;117(1):95-106.
Logan et al., The Wnt signaling pathway in development and disease. Annu Rev Cell Dev Biol. 2004;20:781-810.

(56) References Cited

OTHER PUBLICATIONS

Lohmar et al. Synthese symmetrischerf ketone unter verwendung von 2-Phenyl-2-oxazolin-5-on. (α-Aminosäuren als nucleophile Acyläquivalente, IV.) Chemische Berichte. 1980;113(12):3706-15.
Losey et al., Crystal structure of Staphylococcus aureus tRNA adenosine deaminase TadA in complex with RNA. Nat Struct Mol Biol. Feb. 2006;13(2):153-9. Epub Jan. 15, 2006.
Lou et al., The first three domains of the insulin receptor differ structurally from the insulin-like growth factor 1 receptor in the regions governing ligand specificity. Proc Natl Acad Sci U S A. Aug. 15, 2006;103(33):12429-34. Epub Aug. 7, 2006.
Loughlin et al., Functional variants within the secreted frizzled-related protein 3 gene are associated with hip osteoarthritis in females. Proc Natl Acad Sci U S A. Jun. 29, 2004;101(26):9757-62. Epub Jun. 21, 2004.
Lu et al., Both Pbxl and E2A-Pbx1 bind the DNA motif ATCAATCAA cooperatively with the products of multiple murine Hox genes, some of which are themselves oncogenes. Mol Cell Biol. Jul. 1995;15(7):3786-95.
Lu, et al. Proteomimetic libraries: design, synthesis, and evaluation of p53-MDM2 interaction inhibitors. J Comb Chem. May-Jun. 2006;8(3):315-25.
Lu et al., Structural determinants within Pbxl that mediate cooperative DNA binding with pentapeptide-containing Hox proteins: proposal for a model of a Pbxl-Hox-DNA complex. Mol Cell Biol. Apr. 1996;16(4):1632-40.
Lubman et al., Quantitative dissection of the Notch:CSL interaction: insights into the Notch-mediated transcriptional switch. J Mol Biol. Jan. 19, 2007;365(3):577-89. Epub Oct. 3, 2006.
Luo, et al. Mechanism of helix induction by trifluoroethanol: a framework for extrapolating the helix-forming properties of peptides from trifluoroethanol/water mixtures back to water. Biochemistry. Jul. 8, 1997;36(27):8413-21.
Luo et al., Wnt signaling and human diseases: what are the therapeutic implications? Lab Invest. Feb. 2007;87(2):97-103. Epub Jan. 8, 2007.
Luo, et al. Wnt signaling and hunian diseases: what are the therapeutic implications? Lab Invest. Feb. 2007;87(2):97-103. Epub Jan. 8, 2007.
Luscher et al., The basic region/helix-loop-helix/leucine zipper domain of Myc proto-oncoproteins: function and regulation. Oncogene. May 13, 1999;18(19):2955-66.
Luu et al, Wnt/beta-catenin signaling pathway as a novel cancer drug target. Curr Cancer Drug Targets. Dec. 2004;4(8):653-71.
Lyu, et al. Capping Interactions in Isolated α Helices: Position-dependent Substitution Effects and Structure of a Serine-capped Peptide Helix. Biochemistry. 1993; 32:421-425.
Lyu et al, "α-Helix Stabilization by Natural and Unnatural Amino Acids with Alkyl Side Chains," Proc. Nat'l Acad. Sci. USA 88:5317-5320 (1991).
Macmillan, Evolving strategies for protein synthesis converge on native chemical ligation. Angew Chem Int Ed Engl. Nov. 27, 2006;45(46):7668-72.
Madden, et al. Synthesis of cell-permeable stapled peptide dual inhibitors of the p53-Mdm2/Mdmx interactions via photoinduced cycloaddition. Bioorg Med Chem Lett. Mar. 1, 2011;21(5):1472-5. doi: 10.1016/j.bmcl.2011.01.004. Epub Jan. 7, 2011.
Mai, et al. A proapoptotic peptide for the treatment of solid tumors. Cancer Research. 2001; 61:7709-7712.
Mangold, et al. Azidoalanine mutagenicity in Salmonella: effect of homologation and alpha-Mutat Res. Feb. 1989;216(1):27-33.methyl substitution.
Mannhold, R., Kubinyi, H., Folkers, G., series eds. Molecular Drug Properties: Measurement and Prediction (Methods and Principles in Medicinal Chemistry). Wiley-VCH; 2007.
Marqusee & Baldwin, "Helix Stabilization by Glu- . . . Lys+ Salt Bridges in Short Peptides of De Novo Design," Proc. Nat'l Acad. Sci. USA 84:8898-8902 (1987).
Marshall et al., Back to the future: ribonuclease A. Biopolymers. 2008;90(3):259-77.

Martin, et al. Thermal [2+2] intramolecular cycloadditions of fuller-1,6-enynes. Angew Chem Int Ed Engl. Feb. 20, 2006;45(9):1439-42.
Mcgahon, et al. The end of the (cell) line: methods for the study of apoptosis in vitro. Methods Cell Biol. 1995;46:153-85.
Mckern et al., Structure of the insulin receptor ectodomain reveals a folded-over conformation. Nature. Sep. 14, 2006;443(7108):218-21. Epub Sep. 6, 2006.
McNamara et al. Peptides constrained by an aliphatic linkage between two C(alpha) sites: design, synthesis, and unexpected conformational properties of an i,(i + 4)-linked peptide. J Org Chem. Jun. 29, 2001;66(13):4585-95.
Mellegaard-Waetzig et al., Allylic amination via decarboxylative c-n bond formation Synlett. 2005;18:2759-2762.
Menting et al., A thermodynamic study of ligand binding to the first three domains of the human insulin receptor: relationship between the receptor alpha-chain C-terminal peptide and the site 1 insulin mimetic peptides. Biochemistry. Jun. 16, 2009;48(23):5492-500. doi: 10.1021/bi900261q.
Meyers et al., Formation of mutually exclusive Rabll complexes with members of the family of Rabll-interacting proteins regulates Rabll endocytic targeting and function. J Biol Chem. Dec. 13, 2002;277(50):49003-10. Epub Oct. 9, 2002.
Miller & Scanlan, "oNBS-SPPS: A New Method for Solid-phase Peptide Synthesis," J. Am. Chem. Soc. 120:2690-2691 (1998).
Miller et al., Application of Ring-Closing Metathesis to the Synthesis of Rigidified Amino Acids and Peptides. J Am Chem Soc. 1996;118(40):9606-9614.
Miller et al., Synthesis of Conformationally Restricted Amino Acids and Peptides Employing Olefin Metathesis. J Am Chem Soc. 1995;117(21):5855-5856.
Miloux et al., Cloning of the human IL-13R alphal chain and reconstitution with the IL4R alpha of a functional IL-4/IL-13 receptor complex. FEBS Lett. Jan. 20, 1997;401(2-3):163-6.
Miyaoka et al., Increased expression of Wnt-1 in schizophrenic brains. Schizophr Res. Jul. 27, 1999;38(1):1-6.
Moellering et al., Direct inhibition of the NOTCH transcription factor complex. Nature. Nov. 12, 2009;462(7270):182-8. Erratum in: Nature. Jan. 21, 2010;463(7279):384.
Moon et al., WNT and beta-catenin signalling: diseases and therapies. Nat Rev Genet. Sep. 2004;5(9):689-701.
Morin, beta-catenin signaling and cancer. Bioessays. Dec. 1999;21(12):1021-30.
Morita, et al. Cyclolinopeptides B-E, new cyclic peptides from Linum usitatissimum. Tetrahedron 55.4 (1999): 967-976.
Mosberg, et al. Dithioeter-containing cyclic peptides. J. Am. Chem. Soc. 1985;107(10):2986-2987.
Moses, et al. The growing applications of click chemistry. Chem Soc Rev. Aug. 2007;36(8):1249-62.
Moy et al., Solution structure of human IL-13 and implication for receptor binding. J Mol Biol. Jun. 29, 2001;310(1):219-30.
Muchmore, et al. X-ray and NMR structure of human Bcl-xL, an inhibitor of programmed cell death. Nature. May 23, 1996;381(6580):335-41.
Mudher et al., Alzheimer's disease-do tauists and baptists finally shake hands? Trends Neurosci. Jan. 2002;25(1):22-6.
Muir et al., Expressed protein ligation: a general method for protein engineering. Proc Natl Acad Sci U S A. Jun. 9, 1998;95(12):6705-10.
Muir, Semisynthesis of proteins by expressed protein ligation. Annu Rev Biochem. 2003;72:249-89. Epub Feb. 27, 2003.
Muller, P. Glossary of terms used in physical organic chemistry. Pure and Applied Chemistry, 1994, vol. 66, pp. 1077-1184.
Mulqueen et al. Synthesis of the thiazoline-based siderophore (S)-desferrithiocin. 1993;48(24):5359-5364.
Murray, et al. Targeting protein-protein interactions: lessons from p53/MDM2. Biopolymers. 2007;88(5):657-86.
Mustapa, et al. Synthesis of a Cyclic Peptide Containing Norlanthionine: Effect of the Thioether Bridge on Peptide Conformation. J. Org. Chem. 2003;68(21):8193-8198.
Mynarcik et al., Alanine-scanning mutagenesis of a C-terminal ligand binding domain of the insulin receptor alpha subunit. J Biol Chem. Feb. 2, 1996;271(5):2439-42.

(56) References Cited

OTHER PUBLICATIONS

Mynarcik et al., Identification of common ligand binding determinants of the insulin and insulin-like growth factor 1 receptors. Insights into mechanisms of ligand binding. J Biol Chem. Jul. 25, 1997;272(30):18650-5.
Myung et al., The ubiquitin-proteasome pathway and proteasome inhibitors. Med Res Rev. Jul. 2001;21(4):245-73.
Nair et al., X-ray structures of Myc-Max and Mad-Max recognizing DNA. Molecular bases of regulation by proto-oncogenic transcription factors. Cell. Jan. 24, 2003;112(2):193-205.
Nakashima et al., Cross-talk between Wnt and bone morphogenetic protein 2 (BMP-2) signaling in differentiation pathway of C2C12 myoblasts. J Biol Chem. Nov. 11, 2005;280(45):37660-8. Epub Sep. 2, 2005.
Nam et al., Structural basis for cooperativity in recruitment of MAML coactivators to Notch transcription complexes. Cell. Mar. 10, 2006;124(5):973-83.
Nam et al., Structural requirements for assembly of the CSL. intracellular Notch1.Mastermind-like 1 transcriptional activation complex. J Biol Chem. Jun. 6, 2003;278(23):21232-9. Epub Mar. 18, 2003.
Nefedova et al., Involvement of Notch-1 signaling in bone marrow stroma-mediated de novo drug resistance of myeloma and other malignant lymphoid cell lines. Blood. May 1, 2004;103(9):3503-10. Epub Dec. 11, 2003.
Nelson & Kallenbach, "Persistence of the α-Helix Stop Signal in the S-Peptide in Trifluoroethanol Solutions," Biochemistry 28:5256-5261 (1989).
Ngo et al. Computational complexity, protein structure prediction, and the levinthal paradox. In: The Protein Folding Problem and Tertiary Structure Prediction. K. Merz, Jr., et al. Eds. 1994:433-506.
Ngo et al. Computational complexity, protein structure prediction and the Levinthal Paradox.In: The Protein Folding Problem and Tertiary Structure Prediction. K.Merz, Jr. and S. LeGrand, eds., 1994, pp. 491-495.
Niemann et al., Homozygous WNT3 mutation causes tetra-amelia in a large consanguineous family. Am J Hum Genet. Mar. 2004;74(3):558-63. Epub Feb. 5, 2004.
Nilsson et al., Staudinger ligation: a peptide from a thioester and azide. Org Lett. Jun. 29, 2000;2(13):1939-41.
Niranjan et al., The Notch pathway in podocytes plays a role in the development of glomerular disease. Nat Med. Mar. 2008;14(3):290-8. doi: 10.1038/nm1731. Epub Mar. 2, 2008.
Nishisho et al., Mutations of chromosome 5q21 genes in FAP and colorectal cancer patients. Science. Aug. 9, 1991;253(5020):665-9.
Noah, et al. A cell-based luminescence assay is effective for high-throughput screening of potential influenza antivirals. Antiviral Res. Jan. 2007;73(1):50-9. Epub Jul. 28, 2006.
Node et al., Hard Acid and Soft Nucleophile Systems. 3. Dealkylation of Esters with Aluminum Halide-Thiol and Aluminum Halide-Sulfide Stustems. J Org Chem. 1981;46:1991-93.
Noguera-Troise et al., Blockade of Dll4 inhibits tumour growth by promoting non-productive angiogenesis. Nature. Dec. 21, 2006;444(7122)1032-7.
Notice of allowance dated Jun. 12, 2014 for U.S. Appl. No. 12/525,123.
Notice of allowance dated Aug. 1, 2014 for U.S. Appl. No. 13/767,852.
Notice of allowance dated Aug. 6, 2012 for U.S. Appl. No. 12/796,212.
Notice of allowance dated Nov. 6, 2014 for U.S. Appl. No. 13/767,857.
Notice of Allowance, dated May 30, 2013, for U.S. Appl. No. 12/593,384.
Office action dated Jan. 3, 2013 for U.S. Appl. No. 12/593,384.
Office action dated Jan. 13, 2014 for U.S. Appl. No. 13/767,857.
Office action dated Jan. 17, 2014 for U.S. Appl. No. 13/816,880.
Office action dated Jan. 26, 2009 for U.S. Appl. No. 11/148,976.
Office Action dated Jan. 30, 2008 for U.S. Appl. No. 10/981,873.
Office action dated Feb. 6, 2014 for U.S. Appl. No. 13/680,905.
Office action dated Feb. 9, 2012 for U.S. Appl. No. 12/420,816.
Office action dated Feb. 17, 2011 for U.S. Appl. No. 12/796,212.
Office action dated Mar. 22, 2013 for U.S. Appl. No. 12/233,555.
Office action dated Mar. 26, 2015 for U.S. Appl. No. 14/070,354.
Office action dated Apr. 9, 2014 for U.S. Appl. No. 13/767,852.
Office action dated Apr. 10, 2015 for U.S. Appl. No. 14/460,848.
Office action dated Apr. 18, 2011 for U.S. Appl. No. 12/182,673.
Office action dated Jun. 28, 2012 for U.S. Appl. No. 12/233,555.
Office action dated Jul. 15, 2013 for U.S. Appl. No. 13/570,146.
Office action dated Jul. 16, 2014 for U.S. Appl. No. 13/767,857.
Office action dated Jul. 21, 2014 for U.S. Appl. No. 13/370,057.
Office action dated Jul. 24, 2015 for U.S. Appl. No. 13/252,751.
Office action dated Aug. 6, 2015 for U.S. Appl. No. 14/498,063.
Office action dated Aug. 9, 2010 for U.S. Appl. No. 12/182,673.
Office action dated Sep. 2, 2015 for U.S. Appl. No. 14/608,641.
Office action dated Sep. 18, 2013 for U.S. Appl. No. 13/767,857.
Office action dated Sep. 23, 2013 for U.S. Appl. No. 13/680,905.
Office action dated Oct. 10, 2013 for U.S. Appl. No. 13/816,880.
Office action dated Oct. 18, 2011 for U.S. Appl. No. 12/796,212.
Office action dated Oct. 26, 2015 for U.S. Appl. No. 14/460,848.
Office action dated Nov. 5, 2002 for U.S. Appl. No. 09/574,086.
Office action dated Nov. 25, 2009 for U.S. Appl. No. 11/148,976.
Office action dated Dec. 5, 2008 for U.S. Appl. No. 10/981,873.
Office action dated Dec. 19, 2014 for U.S. Appl. No. 14/068,844.
Office action dated Dec. 29, 2011 for U.S. Appl. No. 12/233,555.
Office action dated Dec. 31, 2013 for U.S. Appl. No. 12/525,123.
Office Communication, dated Jan. 3, 2013, for U.S. Appl. No. 12/593,384.
O'Shea et al., "Mechanism of Specificity in the Fos-Jun Oncoprotein Heterodimer," Cell 68:699-708 (1992).
Okamura et al., Redundant regulation of T cell differentiation and TCRalpha gene expression by the transcription factors LEF-1 and TCF-1. Immunity. Jan. 1998;8(1):11-20.
Olson et al., Sizing up the heart: development redux in disease. Genes Dev. Aug. 15, 2003;17(16):1937-56. Epub Jul. 31, 2003.
O'Neil & DeGrado, "A Thermodynamic Scale for the Helix-forming Tendencies of the Commonly Occurring Amino Acids," Science 250:646-651(1990).
O'Neil et al., FBW7 mutations in leukemic cells mediate NOTCH pathway activation and resistance to gamma-secretase inhibitors. J Exp Med. Aug. 6, 2007;204(8):1813-24. Epub Jul. 23, 2007.
Or et al. Cysteine alkylation in unprotected peptides: synthesis of a carbavasopressin analogue by intramolecular cystein alkylation. J. Org. Chem. Apr. 1991;56(9):3146-3149.
Oswald et al., RBP-Jkappa/Sharp recruits CtIP/CtBP corepressors to silence Notch target genes. Mol Cell Biol. Dec. 2005;25(23):10379-90.
Pakotiprapha et al., Crystal structure of Bacillus stearothermophilus UvrA provides insight into ATP-modulated dimerization, UvrB interaction, and DNA binding. Mol Cell. Jan. 18, 2008;29(1):122-33. Epub Dec. 27, 2007.
Palomero et al., Mutational loss of PTEN induces resistance to NOTCH1 inhibition in T-cell leukemia. Nat Med. Oct. 2007;13(10):1203-10. Epub Sep. 16, 2007.
Pangborn et al., "Safe and Convenient Procedure for Solvent Purification," Organometallics 15:1518-1520 (1996).
Paquette, L.A., ed. Encyclopedia of Reagents for Organic Synthesis. New York; John Wiley & Sons; 1995.
Park et al., Notch3 gene amplification in ovarian cancer. Cancer Res. Jun. 15, 2006;66(12):6312-8.
Parrish et al., Perspectives on alkyl carbonates in organic synthesis. Tetrahedron, 2000; 56(42): 8207-8237.
Patgiri, et al. A hydrogen bond surrogate approach for stabilization of short peptide sequences in alpha-helical conformation. Acc Chem Res. Oct. 2008;41(10):1289-300. Epub Jul. 17, 2008.
Patgiri, et al. Solid phase synthesis of hydrogen bond surrogate derived alpha-helices: resolving the case of a difficult amide coupling. Org Biomol Chem. Apr. 21, 2010;8(8):1773-6.
Pattenden, et al. Enantioselective synthesis of 2-alkyl substituted cysteines. 1993;49(10):2131-2138.

(56) References Cited

OTHER PUBLICATIONS

Pattenden, et al. Naturally occurring linear fused thiazoline-thiazole containing metabolites: total synthesis of (-)-didehydromirabazole A, a cytotoxic alkaloid from blue-green algae. J Chem Soc. 1993;14:1629-1636.
Pazgier, et al. Structural basis for high-affinity peptide inhibition of p53 interactions with MDM2 and MDMX. Proc Natl Acad Sci U S A. Mar. 24, 2009;106(12):4665-70. doi: 10.1073/pnas.0900947106. Epub Mar. 2, 2009.
Pellois et al., Semisynthetic proteins in mechanistic studies: using chemistry to go where nature can't. Curr Opin Chem Biol. Oct. 2006;10(5):487-91. Epub Aug. 28, 2006.
Perantoni, Renal development: perspectives on a Wnt-dependent process. Semin Cell Dev Biol. Aug. 2003;14(4):201-8.
Peryshkov, et al. Z-Selective olefin metathesis reactions promoted by tungsten oxo alkylidene complexes. Am Chem Soc. Dec. 28, 2011;133(51):20754-7. doi: 10.1021/ja210349m. Epub Nov. 30, 2011.
Petros et al., "Rationale for Bcl-xL/Bad Peptide Complex Formation from Structure, Mutagenesis, and Biophysical Studies," Protein Sci. 9:2528-2534 (2000).
Phan, et al. Structure-based design of high affinity peptides inhibiting the interaction of p53 with MDM2 and MDMX. J Biol Chem. Jan. 15, 2010;285(3):2174-83. doi: 10.1074/jbc.M109.073056. Epub Nov. 12, 2009.
Phelan, et al. A General Method for Constraining Short Peptides to an α-Helical Conformation. J. Am. Chem. Soc. 1997;119:455-460.
Picksley et al., Immunochemical analysis of the interaction of p53 with MDM2;—fine mapping of the MDM2 binding site on p53 using synthetic peptides. Oncogene. Sep. 1994;9(9):2523-9.
Pillutla et al., Peptides identify the critical hotspots involved in the biological activation of the insulin receptor. J Biol Chem. Jun. 21, 2002;277(25):22590-4. Epub Apr. 18, 2002.
Pinnix et al., Active Notch1 confers a transformed phenotype to primary human melanocytes. Cancer Res. Jul. 1, 2009;69(13):5312-20. doi: 10.1158/0008-5472.CAN-08-3767. Epub Jun. 23, 2009.
Plenat, et al. [Formaldehyde fixation in the third millennium]. Ann Pathol. Feb. 2001;21(1):29-47.
Polakis, The oncogenic activation of beta-catenin. Curr Opin Genet Dev. Feb. 1999;9(1):15-21.
Qian & Schellman, "Helix-coil Theories: A Comparative Study for Finite Length Polypeptides," J. Phys. Chem. 96:3987-3994 (1992).
Qiu et al., Convenient, Large-Scale Asymmetric Synthesis of Enantiomerically Pure trans-Cinnamylglycine and -a-Alanine. Tetrahedron. 2000;56:2577-82.
Rao et al., Inhibition of NOTCH signaling by gamma secretase inhibitor engages the RB pathway and elicits cell cycle exit in T-cell acute lymphoblastic leukemia cells. Cancer Res. Apr. 1, 2009;69(7):3060-8. doi: 10.1158/0008-5472.CAN-08-4295. Epub Mar. 24, 2009.
Rasmussen, et al. Ruthenium-catalyzed cycloaddition of aryl azides and alkynes. Org Lett. Dec. 20, 2007;9(26):5337-9.
Rawlinson et al., CRM1-mediated nuclear export of dengue virus RNA polymerase NS5 modulates interleukin-8 induction and virus production. J Biol Chem. Jun. 5, 2009;284(23):15589-97. Epub Mar. 18, 2009.
Remington: The Science and Practice of Pharmacy. 19th Edition, 1995.
Reya et al., Wnt signalling in stem cells and cancer. Nature. Apr. 14, 2005;434(7035):843-50.
Rich et al., Synthesis of the cytostatic cyclic tetrapeptide, chlamydocin. Tetranderon Letts. 1983;24(48):5305-08.
Riddoch, et al. A solid-phase labeling strategy for the preparation of technetium and rhenium bifunctional chelate complexes and associated peptide conjugates. Bioconjug Chem. Jan.-Feb. 2006;17(1):226-35.
Ridgway et al., Inhibition of D114 signalling inhibits tumour growth by deregulating angiogenesis. Nature. Dec. 21, 2006;444(7122):1083-7.
Rink, et al. Lantibiotic Structures as Guidelines for the Design of Peptides That Can Be Modified by Lantibiotic Enzymes. Biochemistry. 2005; 44:8873-8882.
Robert, A hierarchical "nesting" approach to describe the stability of alpha helices with side-chain interactions. Biopolymers. 1990;30(3-4):335-47.
Roberts, et al. Efficient synthesis of thioether-based cyclic peptide libraries. Tetrahedon Letters. 1998; 39: 8357-8360.
Roberts, et al. Examination of methodology for the synthesis of cyclic thioether peptide libraries derived from linear tripeptides. J Pept Sci. Dec. 2007;13(12):811-21.
Robitaille et al., Mutant frizzled-4 disrupts retinal angiogenesis in familial exudative vitreoretinopathy. Nat Genet. Oct. 2002;32(2):326-30. Epub Aug. 12, 2002.
Rodova et al., The polycystic kidney disease-1 promoter is a target of the beta-catenin/T-cell factor pathway. J Biol Chem. Aug. 16, 2002;277(33):29577-83. Epub Jun. 4, 2002.
Roehrl et al., "A General Framework for Development and Data Analysis of Competitive High-throughput Screens for Small-molecule Inhibitors of Protein-Protein Interactions by Fluorescence Polarization," Biochemistry 43:16056-16066 (2004).
Roehrl et al., "Discovery of Small-molecule Inhibitors of the NFAT-Calcineurin Interaction by Competitive High-throughput Fluorescence Polarization Screening," Biochemistry 43:16067-16075 (2004).
Roice, et al. High Capacity Poly(ethylene glycol) Based Amino Polymers for Peptide and Organic Synthesis. QSAR & Combinatorial Science. 2004;23(8):662-673.
Rojo, et al. Macrocyclic peptidomimetic inhibitors of β-secretase (BACE): First X-ray structure of a macrocyclic peptidomimetic-BACE complex. Bioorg. Med. Chem. Lett. 2006; 16:191-195.
Roof, et al. Mechanism of action and structural requirements of constrained peptide inhibitors of RGS proteins. Chem Biol Drug Des. Apr. 2006;67(4):266-74.
Roos et al., Synthesis of a-Substituted a-Amino Acids via Cationic Intermediates. J Org Chem. 1993;58:3259-68.
Ross et aL, Inhibition of adipogenesis by Wnt signaling. Science. Aug. 11, 2000;289(5481):950-3.
Rostovtsev, et al. A stepwise huisgen cycloaddition process: copper (i)-catalyzed regioselective "ligation" of azides and terminal alkynes. Angew. Chem. Int. Ed. Engl. Jul. 15, 2002;41(14):2596-2599.
Ruan et al., "Metal Ion Enhanced Helicity in Synthetic Peptides Containing Unnatural, Metal-ligating Residues," J. Am. Chem. Soc. 112:9403-9404 (1990).
Rudinger J, "Characteristics of the amino acids as components of a peptide hormone sequence," Peptide Hormones, JA Parsons Edition, University Park Press, Jun. 1976, pp. 1-7.
Ruffolo and Shore. BCL-2 Selectively Interacts with the BID-Induced Open Conformer of BAK, Inhibiting BAK Auto-Oligomerization. J. Biol. Chem. 2003;278(27):25039-25045.
Rutledge et al., "A View to a Kill: Ligands for Bcl-2 Family Proteins," Curr. Opin. Chem. Biol. 6:479-485 (2002).
Sadot et al., Down-regulation of beta-catenin by activated p53. Mol Cell Biol. Oct. 2001;21(20):6768-81.
Saghiyan, A. S., et al., "New chiral Niii complexes of Schiffs bases of glycine and alanine for efficient asymmetric synthesis of a-amino acids," Tedrahedron: Asymmetry 17: 455-467 (2006).
Saghiyan, et al. Novel modified (S)-N-(benzoylphenyl)-1-(3,4-dichlorobenzyl)-pyrolidine-2-carboxamide derived chiral auxiliarie for asymmetric synthesis of (S)-alpha-amino acids. Chemical Journal of Armenia. Aug. 2002; 55(3):150-161. (abstract only).
Saiki, et al. Primer-directed enzymatic amplification of DNA with a thermostable DNA polymerase. Science. Jan. 29, 1988;239(4839):487-91.
Sali et al., Stabilization of protein structure by interaction of alpha-helix dipole with a charged side chain. Nature. Oct. 20, 1988;335(6192):740-3.
Sampietro et al., Crystal structure of a beta-catenin/BCL9/Tcf4 complex. Mol Cell. Oct. 20, 2006;24(2):293-300.
Sanchez-Garcia, et al. Tumorigenic activity of the BCR-ABL oncogenes is mediated by BCL2. Proc Natl Acad Sci U S A. Jun. 6, 1995;92(12):5287-91.

(56) References Cited

OTHER PUBLICATIONS

Ösapay & Taylor, "Multicyclic Polypeptide Model Compounds. 2. Synthesis and Conformational Properties of a Highly α-Helical Uncosapeptide Constrained by Three Side-chain to Side-chain Lactam Bridges," J. Am. Chem. Soc. 114:6966-6973 (1992).
Satoh et al., AXIN1 mutations in hepatocellular carcinomas, and growth suppression in cancer cells by virus-mediated transfer of AXIN1. Nat Genet. Mar. 2000;24(3):245-50.
Sattler et al. Structure of Bcl-xL-Back peptide complex: recognition between regulators of apoptosis. Science. 1997;275:983-986.
Saxon et al., Cell surface engineering by a modified Staudinger reaction. Science. Mar. 17, 2000;287(5460):2007-10.
Schaffer et al., A novel high-affinity peptide antagonist to the insulin receptor. Biochem Biophys Res Commun. Nov. 14, 2008;376(2):380-3. doi: 10.1016/j.bbrc.2008.08.151. Epub Sep. 7, 2008.
Schaffer et al., Assembly of high-affinity insulin receptor agonists and antagonists from peptide building blocks. Proc Natl Acad Sci U S A. Apr. 15, 2003;100(8):4435-9. Epub Apr. 8, 2003.
Schafmeister et al. An all-hydrocarbon crosslinking system for enhancing the helicity and metabolic stability of peptides. J. Am Chem. Soc. 2000;122:5891-5892.
Scheffzek et al., The Ras-RasGAP complex: structural basis for GTPase activation and its loss in oncogenic Ras mutants. Science. Jul. 18, 1997;277(5324):333-8.
Schinzel et al., The phosphate recognition site of Escherichia coli maltodextrin phosphorylase. FEBS Lett. Jul. 29, 1991;286(1-2):125-8.
Schmiedeberg et al. Reversible backbone protection enables combinatorial solid-phase ring-closing metathesis reaction (RCM) in peptides. Org Lett. Jan. 10, 2002;4(1):59-62.
Scholtz et al., The mechanism of alpha-helix formation by peptides. Annu Rev Biophys Biomol Struct. 1992;21:95-118.
Schrock et al., Tungsten(VI) Neopentylidyne Complexes. Organometallics. 1982;1:1645-51.
Schwarzer et al., Protein semisynthesis and expressed protein ligation: chasing a protein's tail. Curr Opin Chem Biol. Dec. 2005;9(6):561-9. Epub Oct. 13, 2005.
Scorrano, et al. A distinct pathway remodels mitochondrial cristae and mobilizes cytochrome c during apoptosis. Dev Cell. Jan. 2002;2(1):55-67.
Scott, et al. A Solid-Phase Synthetic Route to Unnatural Amino Acids with Diverse Side-Chain Substitutions. Journal of Organic Chemistry. 2002, vol. 67, No. 9, pp. 2960-2969.
Scott et al., Evidence of insulin-stimulated phosphorylation and activation of the mammalian target of rapamycin mediated by a protein kinase B signaling pathway. Proc Natl Acad Sci U S A. Jun. 23, 1998;95(13):7772-7.
Seabra et al., Rab GTPases, intracellular traffic and disease. Trends Mol Med. Jan. 2002;8(1):23-30.
Seebach, et al. Beta-peptidic peptidomimetics. Acc Chem Res. Oct. 2008;41(10):1366-75. doi: 10.1021/ar700263g. Epub Jun. 26, 2008.
Seebach, et al. Self-Regeneration of Stereocenters (SRS)—Applications, Limitations, and Abandonment of a Synthetic Principle. Angew. Chem. Int. Ed. Engl. 1996;35:2708-2748.
Seebeck, et al. Ribosomal synthesis of dehydroalanine-containing peptides. J Am Chem Soc. Jun. 7, 2006;128(22):7150-1.
Seiffert et al., Presenilin-1 and -2 are molecular targets for gamma-secretase inhibitors. J Biol Chem. Nov. 3, 2000;275(44):34086-91.
Shair, A closer view of an oncoprotein-tumor suppressor interaction. Chem Biol. Nov. 1997;4(11):791-4.
Shangary, et al. Targeting the MDM2-p53 interaction for cancer therapy. Clin Cancer Res. Sep. 1, 2008;14(17):5318-24. doi: 10.1158/1078-0432.CCR-07-5136.
Shenk, et al. Biochemical method for mapping mutational alterations in DNA with S1 nuclease: the location of deletions and temperature-sensitive mutations in simian virus 40. Proc Natl Acad Sci U S A. Mar. 1975;72(3):989-93.
Shepherd et al., "Single Turn Peptide Alpha Helices with Exceptional Stability in Water," J. Am. Chem. Soc. 127:2974-2983 (2005).
Shi, et al. The role of arsenic-thiol interactions in metalloregulation of the ars operant. J Biol Chem. Apr. 19, 1996;271(16):9291-7.
Shiba et al., Structural basis for Rabll-dependent membrane recruitment of a family of Rabll-interacting protein 3 (FIP3)/Arfophilin-1. Proc Natl Acad Sci U S A. Oct. 17, 2006;103(42):15416-21. Epub Oct. 9, 2006.
Si et aL, CCN1/Cyr61 is regulated by the canonical Wnt signal and plays an important role in Wnt3A-induced osteoblast differentiation of mesenchymal stem cells. Mol Cell Biol. Apr. 2006;26(8):2955-64.
Sia et al., "Short Constrained Peptides that Inhibit HIV-1 Entry," Proc. Nat'l Acad. Sci. USA 99(23):14664-14669 (2002).
Siddle et al., Specificity in ligand binding and intracellular signalling by insulin and insulin-like growth factor receptors. Biochem Soc Trans. Aug. 2001;29(Pt 4):513-25.
Singh, et al. Efficient asymmetric synthesis of (S)- and (R)-N-Fmoc-S-trityl-alpha-methylcysteine using camphorsultam as a chiral auxiliary.. J Org Chem. Jun. 25, 2004;69(13):4551-4.
Singh et al.,Iridium(I)-catalyzed regio- and enantioselective allylic amidation.Tet. Lett. 2007;48 (40): 7094-7098.
Skinner et al., Basic helix-loop-helix transcription factor gene family phylogenetics and nomenclature. Differentiation. Jul. 2010;80(1):1-8. doi: 10.1016/j.diff.2010.02.003. Epub Mar. 10, 2010.
Smith, et al. Design, Synthesis, and Binding Affinities of Pyrrolinone-Based Somatostatin Mimetics. Organic Letters. Jan. 8, 2005, vol. 7, No. 3, pp. 399-402, plus Supporting Information, pp. S1-S39.
Smith et al., Structural resolution of a tandem hormone-binding element in the insulin receptor and its implications for design of peptide agonists. Proc Natl Acad Sci U S A. Apr. 13, 2010;107(15):6771-6. doi: 10.1073/pnas.1001813107. Epub Mar. 26, 2010.
Soucek et al., Modelling Myc inhibition as a cancer therapy. Nature. Oct. 2, 2008;455(7213):679-83. Epub Aug. 17, 2008.
Sparey et al., Cyclic sulfamide gamma-secretase inhibitors. Bioorg Med Chem Lett. Oct. 1, 2005;15(19):4212-6.
Spierings, et al. Connected to death: the (unexpurgated) mitochondrial pathway of apoptosis. Science. 2005; 310:66-67.
Stein et al., Rab proteins and endocytic trafficking: potential targets for therapeutic intervention. Adv Drug Deliv Rev. Nov. 14, 2003;55(11):1421-37.
Stenmark et al., The Rab GTPase family. Genome Biol. 2001;2(5):3007.1-3007.7.
Stewart, et al. Cell-penetrating peptides as delivery vehicles for biology and medicine. Org Biomol Chem. Jul. 7, 2008;6(13):2242-55. doi: 10.1039/b719950c. Epub Apr. 15, 2008.
Still et al., "Rapid Chromatographic Technique for Preparative Separations with Moderate Resolution," J. Org. Chem. 43(14):2923-2925 (1978).
Still et al., Semianalytical Treatment of Solvation for Molecular Mechanics and Dynamics. J Am Chem Soc. 1990;112:6127-29.
STN search notes for Lu reference, 4 pages, 2006.
Struhl et al., Presenilin is required for activity and nuclear access of Notch in Drosophila. Nature. Apr. 8, 1999;398(6727):522-5.
Stueanaes et al., Beta-adrenoceptor stimulation potentiates insulin-stimulated PKB phosphorylation in rat cardiomyocytes via cAMP and PKA. Br J Pharmacol. May 2010;160(1):116-29. doi: 10.1111/j.1476-5381.2010.00677.x.
Su et al., Eradication of pathogenic beta-catenin by Skpl/Cullin/F box ubiquitination machinery. Proc Natl Acad Sci U S A. Oct. 28, 2003;100(22):12729-34. Epub Oct. 16, 2003.
Surinya et al., Role of insulin receptor dimerization domains in ligand binding, cooperativity, and modulation by anti-receptor antibodies. J Biol Chem. May 10, 2002;277(19):16718-25. Epub Mar. 1, 2002.
Suzuki, et al. Structure of Bax: coregulation of dimer formation and intracellular localization. Cell. Nov. 10, 2000;103(4):645-54.
Szewczuk, et al. Synthesis and Biological activity of new conformationally restricted analogues of pepstatin. Int. J. Peptide Protein. Res. 1992; 40:233-242.

(56) References Cited

OTHER PUBLICATIONS

Takeda et al., Human sebaceous tumors harbor inactivating mutations in LEF I . Nat Med. Apr. 2006;12(4):395-7. Epub Mar. 26, 2006.
Tam, et al. Protein prosthesis: 1,5-disubstituted[1,2,3]triazoles as cis-peptide bond surrogates. J Am Chem Soc. Oct. 24, 2007;129(42):12670-1.
Tanaka, Design and synthesis of non-proteinogenic amino acids and secondary structures of their peptides. Yakugaku Zasshi. Oct. 2006:126(10):931-44. Japanese.
Taylor. The synthesis and study of side-chain lactam-bridged peptides. Biopolymers. 2002;66(1):49-75.
Thallinger, et al. Mcl-1 is a novel therapeutic target for human sarcoma: synergistic inhibition of human sarcoma xenotransplants by a combination of mcl-1 antisense oligonucleotides with low-dose cyclophosphamide. Clin Cancer Res. Jun. 15, 2004;10(12 Pt 1):4185-91.
Therasse, et al. New guidelines to evaluate the response to treatment in solid tumors. European Organization for Research and Treatment of Cancer, National Cancer Institute of the United States, National Cancer Institute of Canada. J Natl Cancer Inst. Feb. 2, 2000;92(3):205-16.
Thompson et al., Mutants of interleukin 13 with altered reactivity toward interleukin 13 receptors. J Biol Chem. Oct. 15, 1999;274(42):29944-50.
Tian et al., Linear non-competitive inhibition of solubilized human gamma-secretase by pepstatin A methylester, L685458, sulfonamides, and benzodiazepines. J Biol Chem. Aug. 30, 2002;277(35):31499-505. Epub Jun. 18, 2002.
Tian et aL, The role of the Wnt-signaling antagonist DKK1 in the development of osteolytic lesions in multiple myeloma. N Engl J Med. Dec. 25, 2003;349(26):2483-94.
Titus, et al. Human K/natural killer cells targeted with hetero-cross-linked antibodies specifically lyse tumor cells in vitro and prevent tumor growth in vivo. J Immunol. Nov. 1, 1987;139(9):3153-8.
Tolbert et al., New methods for proteomic research: preparation of proteins with N-terminal cysteines for labeling and conjugation. Angew Chem Int Ed Engl. Jun. 17, 2002;14(12):2171-4.
Toniolo, Conformationally restricted peptides through short-range cyclizations. Int J Pept Protein Res. Apr. 1990;35(4):287-300.
Toomes et al., Mutations in LRP5 or FZD4 underlie the common familial exudative vitreoretinopathy locus on chromosome 11q. Am J Hum Genet. Apr. 2004;74(4):721-30. Epub Mar. 11, 2004.
Tornoe et al., Peptidotriazoles on solid phase: [1,2,3]-triazoles by regiospecific copper(i)-catalyzed 1,3-dipolar cycloadditions of terminal alkynes to azides. J Org Chem. May 3, 2002;67(9):3057-64.
Torrance et al., Combinatorial chemoprevention of intestinal neoplasia. Nat Med. Sep. 2000;6(9):1024-8.
Torres, et al. Peptide tertiary structure nucleation by side-chain crosslinking with metal complexation and double "click" cycloaddition. Chembiochem. Jul. 21, 2008;9(11):1701-5.
Trnka & Grubbs, "The Development of L2X2Ru=CHR Olefin Metathesis Catalysts: An Organometallic Success Story," Acc. Chem. Res. 34:18-29 (2001).
Tsuji et al., Antiproliferative activity of REIC/Dkk-3 and its significant down-regulation in non-small-cell lung carcinomas. Biochem Biophys Res Commun. Nov. 23, 2001;289(1):257-63.
Tsuji et al., Synthesis of γ, δ -unsaturated ketones by the intramolecular decarboxylative allylation of allyl β-keto carboxylates and alkenyl allyl carbonates catalyzed by molybdenum, nickel, and rhodium complexes. Chemistry Letters. 1984; 13(10):1721-1724.
Tsuruzoe et al., Insulin receptor substrate 3 (IRS-3) and IRS-4 impair IRS-1- and IRS-2-mediated signaling. Mol Cell Biol. Jan. 2001;21(1):26-38.
Tugyi, et al. The effect of cyclization on the enzymatic degradation of herpes simplex virus glycoprotein D derived epitope peptide. J Pept Sci. Oct. 2005;11(10):642-9.
Turner et al., "Mitsunobu Glycosylation of Nitrobenzenesulfonamides: Novel Route to Amadori Rearrangement Products," Tetrahedron Lett. 40:7039-7042 (1999).
Tyndall et al. Macrocycles mimic the extended peptide conformation recognized by aspartic, serine, cysteine and metallo proteases. Curr Med Chem. Jul. 2001;8(8):893-907.
Tyndall, et al. Over one hundred peptide-activated G protein-coupled receptors recognize ligands with turn structure. Chem Rev. Mar. 2005;105(3):793-826.
Tyndall et al., "Proteases Universally Recognize Beta Strands in Their Active Sites," Chem. Rev. 105:973-999 (2005).
Ueki, et al. Improved synthesis of proline-derived Ni(II) complexes of glycine: versatile chiral equivalents of nucleophilic glycine for general asymmetric synthesis of alpha-amino acids. J Org Chem. Sep. 5, 2003;68(18):7104-7.
Ueki et al., Increased insulin sensitivity in mice lacking p85beta subunit of phosphoinositide 3-kinase. Proc Natl Acad Sci U S A. Jan. 8, 2002;99(1):419-24. Epub Dec. 18, 2001.
Ueki et al., Positive and negative regulation of phosphoinositide 3-kinase-dependent signaling pathways by three different gene products of the p85alpha regulatory subunit. Mol Cell Biol. Nov. 2000;20(21):8035-46.
Uesugi et al., The alpha-helical FXXPhiPhi motif in p53: TAF interaction and discrimination by MDM2. Proc Natl Acad Sci U S A. Dec. 21, 1999;96(26):14801-6.
Ullman et al., Luminescent oxygen channeling immunoassay: measurement of particle binding kinetics by chemiluminescence. Proc Natl Acad Sci U S A. Jun. 7, 1994;91(12):5426-30.
U.S. Appl. No. 14/750,649, filed Jun. 25, 2015.
U.S. Appl. No. 14/718,288, filed May 21, 2015.
U.S. Appl. No. 61/385,405, filed Sep. 22, 2010.
Vaickus et al., Immune markers in hematologic malignancies. Crit Rev Oncol Hematol. Dec. 1991; 11(4):267-97.
Van Genderen et al., Development of several organs that require inductive epithelial-mesenchymal interactions is impaired in LEF-1-deficient mice. Genes Dev. Nov. 15, 1994;8(22):2691-703.
Van Gijn et al., The wnt-frizzled cascade in cardiovascular disease. Cardiovasc Res. 2002 Jul;55(1):16-24.
Van Hoof, et al. Identification of cell surface proteins for antibody-based selection of human embryonic stem cell-derived cardiomyocytes. J Proteome Res. Mar. 5, 2010;9(3):1610-8. doi: 10.1021/pr901138a.
Van Maarseveen, et al. Efficient route to C2 symmetric heterocyclic backbone modified cyclic peptides. Org Lett. Sep. 29, 2005;7(20):4503-6.
Varallo et al., Beta-catenin expression in Dupuytren's disease: potential role for cell-matrix interactions in modulating beta-catenin levels in vivo and in vitro. Oncogene. Jun. 12, 2003;22(24):3680-4.
Vartak et al., Allosteric Modulation of the Dopamine Receptor by Conformationally Constrained Type VI (3-Turn Peptidomimetics of Pro-Leu-Gly-NH2. J Med Chem. 2007;50(26):6725-6729.
Vassilev, et al. In Vivo Activation of the p53 Pathway by Small-molecule Antagonists of MDM2. Science. 2004; 303:844-848.
Venancio et al., Reconstructing the ubiquitin network: cross-talk with other systems and identification of novel functions. Genome Biol. 2009;10(3):R33. Epub Mar. 30, 2009.
Verdine et al., Stapled peptides for intracellular drug targets. Methods Enzymol. 2012;503:3-33. doi: 10.1016/B978-0-12-396962-0.00001-X.
Verdine et al., The challenge of drugging undruggable targets in cancer: lessons learned from targeting BCL-2 family members. Clin Cancer Res. Dec. 15, 2007;13(24):7264-70.
Verma et al., Small interfering RNAs directed against beta-catenin inhibit the in vitro and in vivo growth of colon cancer cells. Clin Cancer Res. Apr. 2003;9(4):1291-300.
Viallet, et al. Tallimustine is inactive in patients with previously treated small cell lung cancer. A phase II trial of the National Cancer Institute of Canada Clinical Trials Group. Lung Cancer. Nov. 1996;15(3):367-73.
Vila-Perello, et al. A minimalist design approach to antimicrobial agents based on a thionin template. J Med Chem. Jan. 26, 2006;49(2):448-51.
Voet D, Voet JG, Biochemistry, Second Edition, John Wiley & Sons, Inc., 1995, pp. 235-241.
Walensky, et al. A stapled BID BH3 helix directly binds and activates BAX. Mol. Cell. Oct. 20, 2006;24(2):199-210.

(56) References Cited

OTHER PUBLICATIONS

Walensky, et al. Activation of apoptosis in vivo by a hydrocarbon-stapled BH3 helix. Science. Sep. 3, 2004;305(5689):1466-70.
Walker, et al. General method for the synthesis of cyclic peptidomimetic compounds. Tetrahedron Letters. 2001; 42(34):5801-5804.
Walter et al., Critical role for IL-13 in the development of allergen-induced airway hyperreactivity. J Immunol. Oct. 15, 2001;167(8):4668-75.
Wang, 4-Alkyl-2-trichloromethyloxazolidin-5-ones: Valuable Precursors to Enantiomerically Pure C- and N-Protected a-Alkyl Prolines. Synlett. 1999;1:33-36.
Wang et al. Cell permeable Bcl-2 binding peptides: a chemical approach to apoptosis induction in tumor cells. Cancer Res. Mar. 15, 2000;60(6)1498-502.
Wang, et al. "Click" synthesis of small molecule probes for activity-based fingerprinting of matrix metalloproteases. Chem Commun (Camb). Sep. 28, 2006;(36):3783-5.
Wang et al. Enhanced metabolic stability and protein-binding properties of artificial alpha helices derived from a hydrogen-bond surrogate: application to Bcl-xL. Angew Chem Int Ed Engl. Oct. 14, 2005;44(40):6525-9.
Wang, et al. Evaluation of biologically relevant short alpha-helices stabilized by a main-chain hydrogen-bond surrogate. J Am Chem Soc. Jul. 19, 2006;128(28):9248-56.
Wang, et al. Inhibition of HIV-1 fusion 1-15 by hydrogen-bond-surrogate-based alpha helices. Angewandte Chemie International Edition. 2008; 47(10):1879-1882.
Wang et al., Inhibition of p53 degradation by Mdm2 acetylation. FEBS Lett. Mar. 12, 2004;561(1-3):195-201.
Wang, et al. Nucleation and stability of hydrogen-bond surrogate-based alpha-helices. Org Biomol Chem. Nov. 21, 2006;4(22):4074-81.
Wei et al., Disorder and structure in the Rab11 binding domain of Rab11 family interacting protein 2. Biochemistry. Jan. 27, 2009;48(3):549-57. doi: 10.1021/bi8020197.
Wei, et al. tBID, a membrane-targeted death ligand, oligomerizes BAK to release cytochrome c. Genes Dev. Aug. 15, 2000;14(16):2060-71.
Wels, et al. Synthesis of a novel potent cyclic peptide MC4-ligand by ring-closing metathesis. Bioorg. Med. Chem. Lett. 2005; 13: 4221-4227.
Weng et al., Activating mutations of NOTCH1 in human T cell acute lymphoblastic leukemia. Science. Oct. 8, 2004;306(5694):269-71.
Weng et al., Growth suppression of pre-T acute lymphoblastic leukemia cells by inhibition of notch signaling. Mol Cell Biol. Jan. 2003;23(2):655-64.
Wenninger, et al. International Cosmetic Ingredient Dictionary and Handbook. vol. 2, 7th Edition, 1997, published by The Cosmetic, Toiletry, and Fragrance Association.
Westhoff et al., Alterations of the Notch pathway in lung cancer. Proc Natl Acad Sci U S A. Dec. 29, 2009;106(52):22293-8. doi: 10.1073/pnas.0907781106. Epub Dec. 10, 2009.
Wild et al., "Peptides Corresponding to a Predictive α-Helical Domain of Human Immunodeficiency Virus Type 1 gp4I are Potent Inhibitors of Virus Infection," Proc. Nat'l Acad. Sci. USA 91:9770-9774 (1994).
Wilen et al., Strategies in Optical Resolution. Tetrahedron. 1977;33:2725-36.
Wilen, Tables of Resolving Agents and Optical Resolutions. E.L. Eliel, ed. Universtify of Notre Dame Press, Notre Dame, IN. 1972:268-98.
Williams and IM. Asymmetric Synthesis of Nonsubstituted and α,α-Disubstituted α-Amino Acids via Diastereoselective Glycine Enolate Alkylations. JACS. 1991;113:9276-9286.
Williams et al., Asymmetric synthesis of 2,6-diamino-6-(hydroxymethyl)pimelic acid: assignment of stereochemistry. J Am Chem Soc. 1991;113(18):6976-6981.
Wills-Karp et al., Interleukin-13: central mediator of allergic asthma. Science. Dec. 18, 1998;282(5397):2258-61.

Wills-Karp, Interleukin-13 in asthma pathogenesis. Immunol Rev. Dec. 2004;202:175-90.
Wills-Karp, The gene encoding interleukin-13: a susceptibility locus for asthma and related traits. Respir Res. 2000;1(1):19-23. Epub Jul. 17, 2000.
Wilson et al., Crystal structure of the CSL-Notch-Mastermind ternary complex bound to DNA. Cell. Mar. 10, 2006;124(5):985-96.
Wilson et al., The FIP3-Rab11 protein complex regulates recycling endosome targeting to the cleavage furrow during late cytokinesis. Mol Biol Cell. Feb. 2005;16(2):849-60. Epub Dec. 15, 2004.
Woon et al., Linking of 2-oxoglutarate and substrate binding sites enables potent and highly selective inhibition of JmjC histone demethylases. Angew Chem Int Ed Engl. Feb. 13, 2012;51(7):1631-4. doi: 10.1002/anie.201107833. Epub Jan. 12, 2012.
Wu et al., MAML1, a human homologue of Drosophila mastermind, is a transcriptional co-activator for NOTCH receptors. Nat Genet. Dec. 2000;26(4):484-9.
Wu, et al. Regiospecific Synthesis of 1,4,5-Trisubstituted-1,2,3-triazole via One-Pot Reaction Promoted by Copper(I) Salt. Synthesis. 2005(8): 1314-1318.
Wu, et al. Studies on New Strategies for the Synthesis of Oligomeric 1,2,3-Triazoles. Synlett 2006(4): 0645-0647.
Wu et al., Therapeutic antibody targeting of individual Notch receptors. Nature. Apr. 15, 2010;464(7291):1052-7. doi: 10.1038/nature08878.
Xi et al., Use of DNA and peptide nucleic acid molecular beacons for detection and quantification of rRNA in solution and in whole cells. Appl Environ Microbiol. Sep. 2003;69(9):5673-8.
Xing, et al. Crystal structure of a beta-catenin/axin complex suggests a mechanism for the beta¬ catenin destruction complex. Genes Dev. Nov. 15, 2003;17(22):2753-64. Epub Nov. 4, 2003.
Yang et al. Synthesis and helical structure of lactam bridged BH3 peptides derived from pro-apoptotic Bcl-2 family proteins. Bioorg Med Chem Lett. Mar. 22, 2004;14(6):1403-6.
Yang et al., Therapeutic dosing with anti-interleukin-13 monoclonal antibody inhibits asthma progression in mice. J Pharmacol Exp Ther. Apr. 2005;313(1):8-15. Epub Jan. 11, 2005.
Ye et al., Neurogenic phenotypes and altered Notch processing in Drosophila Presenilin mutants. Nature. Apr. 8, 1999;398(6727):525-9.
Yin et al., "Terphenyl-based Helical Mimetics That Disrupt the p53/HDM2 Interaction," Angew. Chem. Int. Ed. 44:2704-2707 (2005).
Yu et al., The role of Axin2 in calvarial morphogenesis and craniosynostosis. Development. Apr. 2005; 132(8): 1995-2005.
Zamzami et al. The thiol crosslinking agent diamide overcomes the apoptosis-inhibitory effect of Bcl-2 by enforcing mitochondrial permeability transition. Oncogene. Feb. 26, 1998;16(8):1055-63.
Zhang, et al. 310 Helix versus alpha-helix: a molecular dynamics study of conformational preferences of Aib and Alanine. J. American Cancer Society. Dec. 1994; 116(26):11915-11921.
Zhang et al., A cell-penetrating helical peptide as a potential HIV-1 inhibitor. J Mol Biol. May 2, 2008;378(3):565-80. doi: 10.1016/j.jmb.2008.02.066. Epub Mar. 6, 2008.
Zhang, et al. A triazole-templated ring-closing metathesis for constructing novel fused and bridged triazoles. Chem Commun (Camb). Jun. 21, 2007;(23):2420-2.
Zhang, et al. Development of a High-throughput Fluorescence Polarization Assay for Bcl-xL. Anal. Biochem. 2002; 307:70-75.
Zhang, et al. Ruthenium-catalyzed cycloaddition of alkynes and organic azides. J Am Chem Soc. Nov. 23, 2005;127(46):15998-9.
Zhou, et al. Identification of ubiquitin target proteins using cell-based arrays. J Proteome Res. 2007; 6:4397-4406.
Zhou et al., Lymphoid enhancer factor 1 directs hair follicle patterning and epithelial cell fate. Genes Dev. Mar. 15, 1995;9(6):700-13.
Zhou et aL, Tyrosine kinase inhibitor STI-571/Gleevec down-regulates the beta-catenin signaling activity. Cancer Lett. Apr. 25, 2003;193(2):161-70.
Zimm & Bragg, "Theory of the Phase Transition between Helix and Random Coil in Polypeptide Chains," J. Chem. Phys. 31(2):526-535 (1959).

(56) References Cited

OTHER PUBLICATIONS

Zitzow, et al. Pathogenesis of avian influenza A (H5N1) viruses in ferrets. J Virol. May 2002;76(9):4420-9.
Zor et aL, Solution structure of the KIX domain of CBP bound to the transactivation domain of c-Myb. J Mol Biol. Mar. 26, 2004;337(3):521-34.
Co-pending U.S. Appl. No. 15/278,824, filed Sep. 28, 2016.
Notice of allowance dated Aug. 16, 2016 for U.S. Appl. No. 14/483,905.
Office action dated Sep. 20, 2016 for U.S. Appl. No. 14/852,368.
Abbas, et al. (2010). Mdm2 is required for survival of hematopoietic stem cells/progenitors via dampening of ROS-induced p53 activity. Cell Stem Cell 7, 606-617.
Abraham, et al. (2016). Dual targeting of p53 and c-MYC selectively eliminates leukaemic stem cells. Nature 534, 341-346.
Ahn, et al. A convenient method for the efficient removal of ruthenium byproducts generated during olefin metathesis reactions. Organic Letters. 2001; 3(9):1411-1413.
Akala, et al. (2008). Long-term haematopoietic reconstitution by Trp53-/-p16Ink4a-/-p19Arf-/-multipotent progenitors. Nature 453, 228-232.
Andreeff, et al. (2016). Results of the Phase I Trial of RG7112, a Small-Molecule MDM2 Antagonist in Leukemia. Clin Cancer Res 22, 868-876.
Arora, "Design, Synthesis, and Properties of the Hydrogen Bond Surrogate-based Artificial Alpha-helices," American Chemical Society Meeting, San Diego (Mar. 2005) (oral).
Arora, "Hydrogen Bond Surrogate Approach for the Synthesis of Short α-Helical Peptides," American Chemical Society Meeting, Philadelphia (Aug. 2004) (abstract of oral presentation).
Asai, et al. (2012). Necdin, a p53 target gene, regulates the quiescence and response to genotoxic stress of hematopoietic stem/progenitor cells. Blood 120, 1601-1612.
Avantaggiati, M.L. Molecular horizons of cancer therapeutics: 11th Pezcoller symposium. Biochim Biophys Acta. May 17, 2000;1470(3):R49-59.
Balof, et al. Olefin metathesis catalysts bearing a pH-responsive NHC ligand: a feasible approach to catalyst separation from RCM products. Dalton Trans. Nov. 14, 2008;(42):5791-9. doi: 10.1039/b809793c. Epub Sep. 12, 2008.
Barreyro, et al. (2012). Overexpression of IL-1 receptor accessory protein in stem and progenitor cells and outcome correlation in AML and MDS. Blood 120, 1290-1298.
Berezowska; et al., "Cyclic dermorphin tetrapeptide analogues obtained via ring-closing metathesis. Acta Biochim Pol. 2006;53(1):73-6. Epub Feb. 23, 2006."
Bernal, et al. (2010). A stapled p53 helix overcomes HDMX-mediated suppression of p53. Cancer Cell 18, 411-422.
Bernal et al., Reactivation of the p53 tumor suppressor pathway by a stapled p53 peptide. (2007) J. Am Chem Soc. 9129, 2456-2457.
Bertrand, et al. (1998). Localization of ASH1 mRNA particles in living yeast. Mol Cell 2, 437-445.
Bo, M.D., et al. (2010). MDM4 (MDMX) is overexpressed in chronic lymphocytic leukaemia (CLL) and marks a subset of p53wild-type CLL with a poor cytotoxic response to Nutlin-3. Br J Haematol 150, 237-239.
Brunel, et al. Synthesis of constrained helical peptides by thioether ligation: application to analogs of gp41. Chemical communications. 2005;20:2552-2554.
Bueso-Ramos, et al. (1993). The human MDM-2 oncogene is overexpressed in leukemias. Blood 82, 2617-2623.
Burgess, et al. (2016). Clinical Overview of MDM2/X-Targeted Therapies. Front Oncol. 2016; 6: 7.
Cai, et al. Synthesis of new potent agonistic analogs of growth hormone-releasing hormone (GHRH) and evaluation of their endocrine and cardiac activities. Peptides. 2014; 52:104-112.
Carlo-Stella, et al. Use of recombinant human growth hormone (rhGH) plus recombinant human granulocyte colony-stimulating factor (rhG-CSF) for the mobilization and collection of CD34+ cells in poor mobilizers. Blood. May 1, 2004;103(9):3287-95. Epub Jan. 15, 2004.
Carvajal, et al. (2012). E2F7, a novel target, is up-regulated by p53 and mediates DNA damage-dependent transcriptional repression. Genes Dev 26, 1533-1545.
Cervini, et al. Human growth hormone-releasing hormone hGHRH(1-29)-NH2: systematic structure-activity relationship studies. J Med Chem. Feb. 26, 1998;41(5):717-27.
Chakrabartty et al., "Helix Propensities of the Amino Acids Measured in Alanine-based Peptides without Helix-stabilizing Sidechain Interactions," Protein Sci. 3:843-852 (1994).
Chang, et al. (2013). Stapled alpha-helical peptide drug development: a potent dual inhibitor of MDM2 and MDMX for p53-dependent cancer therapy. Proc Natl Acad Sci U S A 110, E3445-3454.
Cho, et al. An efficient method for removal of ruthenium byproducts from olefin metathesis reactions. Org Lett. Feb. 2003 20;5(4):531-3.
Clavier, et al. Ring-closing metathesis in biphasic BMI.PF6 ionic liquid/toluene medium: a powerful recyclable and environmentally friendly process. Chem Commun (Camb). Oct. 21, 2004;(20):2282-3. Epub Aug. 25, 2004.
Conrad, et al. Ruthenium-Catalyzed Ring-Closing Metathesis: Recent Advances, Limitations and Opportunities. Current Organic Chemistry. Jan. 2006; vol. 10, No. 2, 10(2):185-202(18).
Co-pending U.S. Appl. No. 15/349,478, filed Nov. 11, 2016.
Co-pending U.S. Appl. No. 15/463,826, filed Mar. 20, 2017.
Co-pending U.S. Appl. No. 15/493,301, filed Apr. 21, 2017.
Co-pending U.S. Appl. No. 15/592,517, filed May 11, 2017.
Co-pending U.S. Appl. No. 15/625,672, filed Jun. 16, 2017.
Coy,et al. Structural Simplification of Potent Growth Hormone-Releasing Hormone Analogs: Implications for Other Members of the VIP/GHRW PACAP Family. Annals of the New York Academy of Sciences. VIP, PACAP, Glucagon, and Related Peptides. Dec. 1996; 805:149-158.
Deiters, et al. Adding amino acids with novel reactivity to the genetic code of *Saccharomyces cerevisiae*. J Am Chem Soc. Oct. 1, 2003;125(39):11782-3.
Dennis et al. Albumin binding as a general strategy for improving the pharmacokinetics of proteins. J Biol Chem. 277(38):35035-35043 (2002).
Dimartino et al, "A General Approach for the Stabilization of Peptide Secondary Structures," American Chemical Society Meeting, New York (Sep. 2003) (poster).
Dubreuil, et al. Growth hormone-releasing factor: structural modification or protection for more potent analogs. Comb Chem High Throughput Screen. Mar. 2006;9(3):171-4.
Dyson, et al. Applications of ionic liquids in synthesis and catalysis. Interface-Electrochemical Society. 2007; 16(1), 50-53.
European Medicines Agency, Guideline on the specification limits for residues of metal catalysts or metal regents. Feb. 2008; pp. 1-34.
European Medicines Agency (Pre-authorization Evaluation of Medicines for Human Use, London, Jan. 2007, p. 1-32).
Faderl, et al. (2000). The prognostic significance of p16(INK4a)/p14(ARF) locus deletion and MDM-2 protein expression in adult acute myelogenous leukemia. Cancer 89, 1976-1982.
Felix et al. Biologically active cyclic (lactam) analogs of growth hormone-releasing factor: Effect of ring size and location on conformation and biological activity. Proceedings of the Twelfth American Peptide Symposium. p. 77-79:1991.
Ferdinandi, et al. Non-clinical pharmacology and safety evaluation of TH9507, a human growth hormone-releasing factor analogue. Basic Clin Pharmacol Toxicol. Jan. 2007;100(1):49-58.
Freedman, et al. Structural basis for recruitment of CBP/p300 by hypoxia-inducible factor-1 alpha. Proc Natl Acad Sci U S A. Apr. 16, 2002;99(8):5367-72.
Fry et al. Solution structures of cyclic and dicyclic analogues of growth hormone releasing factor as determined by two-dimensional NMR and CD spectroscopies and constrained molecular dynamics. Biopolymers. Jun. 1992;32(6):649-66.
Galande, et al. An effective method of on-resin disulfide bond formation in peptides. Journal of combinatorial chemistry. 2005;7(2):174-177.

(56) References Cited

OTHER PUBLICATIONS

Gallou, et al. A practical method for the removal of ruthenium byproducts by supercritical fluid extraction. Organic Process Research and Development. 2006; 10:937-940.
Gras-Masse, et al. Influence of helical organization on immunogenicity and antigenicity of synthetic peptides. Mol Immunol. Jul. 1988;25(7):673-8.
Gu, et al. (2002). Mutual dependence of MDM2 and MDMX in their functional inactivation of p53. J Biol Chem 277, 19251-19254.
Hamard, et al (2012). P53 basic C terminus regulates p53 functions through DNA binding modulation of subset of target genes. J Biol Chem 287, 22397-22407.
Haupt, et al. (1997). Mdm2 promotes the rapid degradation of p53. Nature 387, 296-299.
Hecht, S.M., ed. Bioorganic Chemistry: Peptides and Proteins. Oxford University Press. New York; 1998.
Honda, et al. Oncoprotein MDM2 is a ubiquitin ligase E3 for tumor suppressor p53. FEBS Lett. Dec. 22, 1997;420(1):25-7.
Hong, et al. Efficient removal of ruthenium byproducts from olefin metathesis products by simple aqueous extraction. Org Lett. May 10, 2007;9(10):1955-7.
Hossain, et al. Solid phase synthesis and structural analysis of novel A-chain dicarba analogs of human relaxin-3 (INSL7) that exhibit full biological activity. Org Biomol Chem. Apr. 21, 2009;7(8):1547-53. doi: 10.1039/b8218821. Epub Feb. 24, 2009.
International search report and written opinion dated Feb. 7, 2013 for PCT Application No. US12/60913.
International search report and written opinion dated May 18, 2010 for PCT Application No. US2009/057592.
International search report dated May 11, 2006 for PCT Application No. US2005/016894.
International search report dated Mar. 17, 2010 for PCT Application No. US2009-057931.
International search report with written opinion dated Feb. 16, 2017 for PCT/US2016/045165.
Ishikawa, et al. (2007). Chemotherapy-resistant human AML stem cells home to and engraft within the bone-marrow endosteal region. Nat Biotechnol 25, 1315-1321.
Izdebski, et al. Synthesis and biological evaluation of superactive agonists of growth hormone-releasing hormone. Proc Natl Acad Sci USA. May 23, 1995;92(11):4872-6.
Jones, et al. (1998). Overexpression of Mdm2 in mice reveals a p53-independent role for Mdm2 in tumorigenesis. Proc Natl Acad Sci U S A 95, 15608-15612.
Jung, et al. (2013). TXNIP maintains the hematopoietic cell pool by switching the function of p53 under oxidative stress. Cell Metab 18, 75-85.
Kandoth et al. Mutational landscape and significance across 12 major cancer types. Nature 502(7471):333-339 (2013).
Kemp et al., "Studies of N-Terminal Templates for α-Helix Formation. Synthesis and Conformational Analysis of Peptide Conjugates of (2S,5S,8S,11S)-1-Acetyl-1,4-diaza-3-keto-5-carboxy-10-thiatricyclo[2.8.1.04,8]-tridecane (Ac-Hel1-OH)," J. Org. Chem. 56:6683-6697 (1991).
Kubbutat, et al. Regulation of p53 stability by Mdm2. Nature. May 15, 1997;387(6630):299-303.
Kung, et al. Suppression of tumor growth through disruption of hypoxia-inducible transcription. Nature Medicine. 2000; 6(12):1335-1340.
Larock, A. Comprehensive Organic Transformations. VCH Publishers, (1989).
Lenntech BV Water Treatment Solutions. http://www.lenntech.com/periodic/elements/ru.htm.Copyright © 1998-2014.
Lenos, et al. (2012). Alternate splicing of the p53 inhibitor HDMX offers a superior prognostic biomarker than p53 mutation in human cancer. Cancer Res 72, 4074-4084.
Li, et al. (2012). Activation of p53 by SIRT1 inhibition enhances elimination of CML leukemia stem cells in combination with imatinib. Cancer Cell 21, 266-281.
Li, et al. (2014). MDM4 overexpressed in acute myeloid leukemia patients with complex karyotype and wild-type TP53. PLoS One 9, e113088.
Li, et al. Application of Olefin Metathesis in Organic Synthesis. Speciality Petrochemicals. 2007; 79-82 (in Chinese with English abstract).
Liu, et al. (2009). The p53 tumor suppressor protein is a critical regulator of hematopoietic stem cell behavior. Cell Cycle 8, 3120-3124.
Makimura, et al. Reduced growth hormone secretion is associated with increased carotid intima-media thickness in obesity. J Clin Endocrinol Metab. Dec. 2009;94(12):5131-8. doi: 10.1210/jc.2009-1295. Epub Oct. 16, 2009.
Maynard, et al. Purification technique for the removal of ruthenium from olefin metathesis reaction products. Tetrahedron Letters. 1999; 40:4137-4140.
Mayo, et al. International Union of Pharmacology. XXXV. The glucagon receptor family. Pharmacol Rev. Mar. 2003;55(1):167-94.
Min, et al. Structure of an HIF-1alpha-pVHL complex: hydroxyproline recognition in signaling. Science. Jun. 7, 2002;296(5574):1886-9.
Muppidi, et al. Achieving cell penetration with distance-matching cysteine cross-linkers: a facile route to cell-permeable peptide dual inhibitors of Mdm2/Mdmx. Chem Commun (Camb). Sep. 7, 2011;47(33):9396-8. doi: 10.1039/c1cc13320a. Epub Jul. 19, 2011.
Murphy, et al. Growth hormone exerts hematopoietic growth-promoting effects in vivo and partially counteracts the myelosuppressive effects of azidothymidine. Blood. Sep. 15, 1992;80(6):1443-7.
Nicole, et al. Identification of key residues for interaction of vasoactive intestinal peptide with human VPAC1 and VPAC2 receptors and development of a highly selective VPAC1 receptor agonist. Alanine scanning and molecular modeling of the peptide. J Biol Chem. Aug. 4, 2000;275(31):24003-12.
Nobuo Izimiya et al. Pepuchido Gosei no Kiso to Jikken (Fundamental of peptide synthesis and experiments, Jan. 20, 1985, p. 271.
Notice of allowance dated May 12, 2016 for U.S. Appl. No. 14/750,649.
Notice of allowance dated Aug. 31, 2016 for U.S. Appl. No. 14/750,649.
Notice of allowance dated Feb. 15, 2017 for U.S. Appl. No. 14/852,368.
Notice of allowance dated Mar. 2, 2017 for U.S. Appl. No. 14/852,368.
Notice of allowance dated Mar. 29, 2017 for U.S. Appl. No. 14/852,368.
Notice of allowance dated Mar. 30, 2015 for U.S. Appl. No. 13/655,378.
Notice of Allowance dated Jul. 22, 2015 for U.S. Appl. No. 14/070,367.
Notice of allowance dated Sep. 14, 2015 for U.S. Appl. No. 13/350,644.
Notice of allowance dated Sep. 22, 2015 for U.S. Appl. No. 12/564,909.
Office action dated Feb. 6, 2014 for U.S. Appl. No. 13/350,644.
Office action dated Feb. 13, 2013 for U.S. Appl. No. 12/564,909.
Office action dated Mar. 3, 2017 for U.S. Appl. No. 14/460,848.
Office action dated Mar. 18, 2009 for U.S. Appl. No. 11/678,836.
Office action dated Apr. 17, 2017 for U.S. Appl. No. 15/287,513.
Office action dated Apr. 24, 2015 for U.S. Appl. No. 12/564,909.
Office action dated Apr. 24, 2015 for U.S. Appl. No. 13/350,644.
Office action dated Apr. 28, 2017 for U.S. Appl. No. 14/608,641.
Office action dated May 17, 2017 for U.S. Appl. No. 14/864,687.
Office action dated Jun. 18, 2014 for U.S. Appl. No. 12/564,909.
Office action dated Nov. 26, 2013 for U.S. Appl. No. 13/655,378.
Office action dated Dec. 19, 2012 for U.S. Appl. No. 13/350,644.
Office action dated May 29, 2013 for U.S. Appl. No. 13/350,644.
Oliner, et al. Oncoprotein MDM2 conceals the activation domain of tumour suppressor p53. Nature. Apr. 29, 1993;362(6423):857-60.
Parthier, et al. Passing the baton in class B GPCRs: peptide hormone activation via helix induction? Trends Biochem Sci. Jun. 2009;34(6):303-10. doi: 10.1016/j.tibs.2009.02.004. Epub May 14, 2009.

(56) References Cited

OTHER PUBLICATIONS

Passegue, et al. (2003). Normal and leukemic hematopoiesis: are leukemias a stem cell disorder or a reacquisition of stem cell characteristics? Proc Natl Acad Sci U S A 100 Suppl 1, 11842-11849.
Peller, et al. (2003). TP53 in hematological cancer: low incidence of mutations with significant clinical relevance. Hum Mutat 21, 277-284.
Punna, et al. Head-to-tail peptide cyclodimerization by copper-catalyzed azide-alkyne cycloaddition. Angew Chem Int Ed Engl. Apr. 8, 2005;44(15):2215-20.
Qi, J., et al. (2015). HDAC8 Inhibition Specifically Targets Inv(16) Acute Myeloid Leukemic Stem Cells by Restoring p53 Acetylation. Cell Stem Cell 17, 597-610.
Ran, et al. Double Nicking by RNA-Guided CRISPR Cas9 for Enhanced Genome Editing Specificity. Cell. Aug. 28, 2013. pii: S0092-8674(13)01015-5. doi: 10.1018/j.cell.2013.08.021. [Epub ahead of print].
Reis, et al. (2016). Acute myeloid leukemia patients' clinical response to idasanutlin (RG7388) is associated with pre-treatment MDM2 protein expression in leukemic blasts. Haematologica 101, e185-188.
Robberecht, et al. Structural requirements for the activation of rat anterior pituitary adenylate cyclase by growth hormone-releasing factor (GRF): discovery of (N-Ac-Tyr1, D-Arg2)-GRF(1-29)-NH2 as a GRF antagonist on membranes. Endocrinology. Nov. 1985;117(5):1759-64.
Samant et al. "Structure activity relationship studies of gonadotropin releasing hormone antagonists containing S-aryl/alkyl norcysteines and their oxidized derivatives," J. Med. Chem. Apr. 3, 2007. vol. 50, No. 3, pp. 2067-2077.
Schafmeister, et al. An all-hydrocarbon cross-linking system for enhancing the helicity and metabolic stability of peptides. Journal of the American Chemical Society. 2000;122(24):5891-5892.
Seebach, et al. Self-Regeneration of Stereocenters (SRS)—Applications, Limitations, and Abandonment of a Synthetic Principle. Angewandte Chemie International Edition in English. 1996;35(23-24):2708-2748.
Sharp, et al. (1999). Stabilization of the MDM2 oncoprotein by interaction with the structurally related MDMX protein. J Biol Chem 274, 38189-38196.
Shvarts, et al. (1996). MDMX: a novel p53-binding protein with some functional properties of MDM2. EMBO J 15, 5349-5357.
Spouge, et al. Strong conformational propensities enhance t cell antigenicity. J Immunol. Jan. 1, 1987;138(1):204-12.
Stad, et al. (2000). Hdmx stabilizes Mdm2 and p53. J Biol Chem 275, 28039-28044.
Stad, et al. (2001). Mdmx stabilizes p53 and Mdm2 via two distinct mechanisms. EMBO Rep 2, 1029-1034.
Stymiest, et al. Supporting information for: Solid Phase Synthesis of Dicarba Analogs of the Biologically Active Peptide Hormone Oxytocin Using Ring Closing Metathesis. Organic Letters. 2003. 1-8.
Stymiest, et al. Synthesis of biologically active dicarba analogues of the peptide hormone oxytocin using ring-closing metathesis. Org Lett. Jan. 9, 2003;5(1):47-9.
Su, et al. In vitro stability of growth hormone releasing factor (GRF) analogs in porcine plasma. Horm Metab Res. Jan. 1991;23(1):15-21.
Suter, et al. (2011). Mammalian genes are transcribed with widely different bursting kinetics. Science 332, 472-474.
Takeishi, et al. (2013). Ablation of Fbxw7 eliminates leukemia-initiating cells by preventing quiescence. Cancer Cell 23, 347-361.
Tan, et al. (2014). High Mdm4 levels suppress p53 activity and enhance its half-life in acute myeloid leukaemia. Oncotarget 5, 933-943.
Tang, et al. Construction and activity of a novel GHRH analog, Pro-Pro-hGHRH(1-44)-Gly-Gly-Cys. Acta Pharmacol Sin. Nov. 2004;25(11):1464-70.
Tanimura, et al. (1999). MDM2 interacts with MDMX through their Ring finger domains. FEBS Lett 447, 5-9.
Tian, et al. Recombinant human growth hormone promotes hematopoietic reconstitution after syngeneic bone marrow transplantation in mice. Stem Cells. 1998;16(3):193-9.
Tornoe, et al. Peptidotriazoles on solid phase: [1,2,3]-triazoles by regiospecific copper(i)-catalyzed 1,3-dipolar cycloadditions of terminal alkynes to azides. J Org Chem. May 3, 2002;67(9):3057-64.
Vassilev, et al. (2004). In vivo activation of the p53 pathway by small-molecule antagonists of MDM2. Science 303, 844-848.
Vera, et al. (2016). Single-Cell and Single-Molecule Analysis of Gene Expression Regulation. Annu Rev Genet 50, 267-291.
Vu, et al. (2013). Discovery of RG7112: A Small-Molecule MDM2 Inhibitor in Clinical Development. ACS Med Chem Lett 4, 466-469.
Walensky et al., A stapled BID BH3 helix directly binds and activates BAX. (2006) Mol Cell 24:199-210.
Walensky, et al. Activation of apoptosis in vivo by a hydrocarbon-stapled BH3 helix. Science. 2004;305(5689)1466-1470.
Wang, et al. (2011). Fine-tuning p53 activity through C-terminal modification significantly contributes to HSC homeostasis and mouse radiosensitivity. Genes Dev 25, 1426-1438.
Wang et al., "Recognition of a Protein Receptor with the Hydrogen Bond Surrogate-based Artificial Alpha-helices," American Chemical Society Meeting, San Diego (Mar. 2005) (poster).
Wang et al., "Recognition of a Protein Receptor with the Hydrogen Bond Surrogate-based Artificial Alpha-helices," Chemical Biology Symposium, Hunter College (Jan. 2005) (poster).
Wuts, et al. Protective Groups in Organic Synthesis. 2nd Ed., John Wiley and Songs (1991).
Xiong, et al. (2010). Spontaneous tumorigenesis in mice overexpressing the p53-negative regulator Mdm4. Cancer Res 70, 7148-7154.
Yee, et al. Efficient large-scale synthesis of BILN 2061, a potent HCV protease inhibitor, by a convergent approach based on ring-closing metathesis. J Org Chem. Sep. 15, 2006;71(19):7133-45.
Zeisig, et al. (2012). SnapShot: Acute myeloid leukemia. Cancer Cell 22, 698-698 e691.
Zhao, et al. (2010). p53 loss promotes acute myeloid leukemia by enabling aberrant self-renewal. Genes Dev 24, 1389-1402.
Zhao, et al. (2015). Small-molecule inhibitors of the MDM2-p53 protein-protein interaction (MDM2 Inhibitors) in clinical trials for cancer treatment. J Med Chem 58, 1038-1052.

\* cited by examiner

FIG. 6A

| SP# | MW | Sequence | SJSA-1 Cell viability EC50 (μM) serum free | | Competition ELISA IC50 (nM) | | p53 Nuclear translocation of p53 (GRIP assay) | Affinity selection MS Kd (nM) | | p21 activation ELISA | | | FP Competition Binding IC50 (nM) | | CD %Helicity | |
|---|---|---|---|---|---|---|---|---|---|---|---|---|---|---|---|---|
| | | | 24h | 72h | GST-hDM2 | GST-hDMX | | GST-hDM2 | GST-hDMX | 20μM | 10μM | 1μM | HDM2 | HDMx | 0%TFE | 50%TFE |
| SP-1 | 2069.40 | Ac-LSQETFв8DLWKLLВEN-NH2 | >50 | | | | | | | | | | | | | |
| SP-2 | 2067.43 | Ac-LSQETFв8NLWKLLSQN-NH2 | >50 | | | | | | | | | | | | | |
| SP-3 | 2094.46 | Ac-LSQQTFв8NLWRLLSQN-NH2 | 17.6; 10.3 | | 13.4 | | | | | | | | | | | |
| SP-4 | 2081.42 | Ac-QSQQTFв5NLWKLLSQN-NH2 | 36.8; 21.2 | | | | | | | | | | | | | |
| SP-5 | 2109.4 | Ac-QSQQTFв8NLWRLLSQN-NH2 | 22.6, 16.5, 18.4, 18.4 17.1, 17.9 | 12.0 | 2.7; 5.4 | 57; 56 | 14.3 | 25 | | 32; 16 | 1 | 0.9 | 74.8, 76.5 | 100 | | |
| SP-6 | 2083.33 | Ac-QSQQTAв8NLWRLLSQN-NH2 | >50 | >25 | >1000 | >1000 | >50 | | | | | | | | | |
| SP-7 | 2107.46 | Ac-QAbQQTFв8NLWRLLSQN-NH2 | 19.9; 14.3; 10.3 | >25 | | | | | | | | | | | | |
| SP-8 | 2001.21 | Ac-QSQQTFв5NLWRLLPQN-NH2 | >50 | | | | | | | | | | | | | |
| SP-9 | 2137.48 | Ac-QSQQTFв8NLWRLLSQN-NH2 | 7.3 | | >1000 | >1000 | | 90 | | | | | 5 | 34 | | |
| SP-10 | 2065.40 | Ac-QSQAbITFв8NLWRLLSQN-NH2 | 11.4 | | 26.6 | | | | | | | | 55 | 98 | | |
| SP-11 | 2052.38 | Ac-QSQQTFв8NLWRLLSAN-NH2 | 13.0 | | 15.9 | | | | | | | | | | | |
| SP-12 | 2052.38 | Ac-QSQQTFв8ALWRLLSQN-NH2 | 10.0 | | 17.4 | | | | | | | | | | | |
| SP-13 | 2066.40 | Ac-QSQQTFв8ALWRLLSQN-NH2 | 13.7 | | | | | | | | | | | | | |
| SP-14 | 2110.41 | Ac-QSQETFв8NLWRLLSQN-NH2 | >50 | | | | | | | | | | | | | |
| SP-15 | 2137.49 | Ac-RSQQTFв8NLWRLLSQN-NH2 | 5.6 | | 42.3 | 199, | 13.45 | | | | | | 62.3 | 94.6 | | |
| SP-16 | 2138.47 | Ac-RSQQTFв8NLWRLLSEN-NH2 | 10.3 | | 13.5 | | | | | | | | | | | |
| SP-17 | 1961.17 | Ac-LSQETFв5DLWKLLPEN-NH2 | >50 | | | | | | | | | | | | | |
| SP-18 | 2009.31 | Ac-QSQQTFв5NLWRLLPQN-NH2 | >50 | | | | | | | | | | | | | |
| SP-19 | 2037.28 | Ac-QSQQSFв5NSWRLLPQN-NH2 | >50 | | | | | | | | | | | | | |
| SP-20 | 1918.16 | Ac-QSQQTSSNLSRLLPQN-NH2 | >50 | | | | | | | | | | | | | |
| SP-21 | 2038.28 | Ac-QSQQTFв5NLWSLLPQN-NH2 | >50 | | | | | | | | | | | | | |
| SP-22 | 2311.64 | Ac-RTQATFв8NLQWAIDANIв5TNAbITR-NH2 | 35.2 | | | | | | | | | | | | | |
| SP-23 | 2137.49 | Ac-QSQQTFв8NLWRLLSRN-NH2 | >50 | | | | | | | | | | | | | |
| SP-24 | 2137.49 | Ac-QSQRTFв8NLWRLLSQN-NH2 | >50 | | | | | | | | | | | | | |

FIG. 6B

| SP# | MW | Sequence | SJSA-1 Cell viability EC50 (µM serum free) 24h | 72h | Competition ELISA IC50 (nM) GST-hDM2 | GST-hDMX | p53 Nuclear translocation of p53 (GRIP assay) | Affinity selection MS Kd (nM) GST-hDM2 | GST-hDMX | p21 activation ELISA 20µM | 10µM | 1µM | FP Competition Binding IC50 (nM) HDM2 | HDMx | CD %Helicity 0%TFE | 50%TFE |
|---|---|---|---|---|---|---|---|---|---|---|---|---|---|---|---|---|
| SP-25 | 2109.43 | Ac-QSQQTF$_8$NNleWRLLSQN-NH2 | | | | | | | | | | | | | | |
| SP-26 | 2109.43 | Ac-QSQQTFS$_8$NLWRNleLSQN-NH2 | 14.8; 6.2; 11.8; 19.7 | | | | | | | | | | | | | |
| SP-27 | 2109.43 | Ac-QSQQTFS$_8$NLWRLNleSQN-NH2 | 14.8 | | | | | | | | | | | | | |
| SP-28 | 2125.43 | Ac-QSQQTYS$_8$NLWRLLSQN-NH2 | >50 | | | | | | | | | | | | | |
| SP-29 | 2135.51 | Ac-RaNleQQTFS$_8$NLWRLLSQN-NH2 | 5; 4.9; 11.5; 19.5 | | | | | | | | | | | | | |
| SP-30 | 1599.83 | Ac-MPREMDYWEGLN-NH2 | | | 64 | | 26.8 | | | 62.6 | 1.1 | 0.9 | | | 7.5 | 58.2 |
| SP-31 | 2192.57 | Ac-RSQQRFS$_8$NLWRLLSQN-NH2 | 8.6 | | | | | | | | | | | | | |
| SP-32 | 2164.51 | Ac-QSQQRFS$_8$NLWRLLSQN-NH2 | 15.5; 6.9 | | | | | | | | | | | | | |
| SP-33 | 2190.59 | Ac-RaNleQQRFS$_8$NLWRLLSQN-NH2 | 7.6 | | | | | | | | | | | | | |
| SP-34 | 2226.58 | Ac-RSQQRFS$_8$NHFWRLLSQN-NH2 | 5.2, 4.8 | | | | | | | | | | | | | |
| SP-35 | 2242.58 | Ac-RSQQRFS$_8$NYWRLLSQN-NH2 | 5.3, 5.7, 11.4 | | | | | | | | | | | | | |
| SP-36 | 2109.43 | Ac-RSQQTFS$_8$NLWQLLSQN-NH2 | 41.9 | | | | | | | | | | | | | |
| SP-37 | 2095.40 | Ac-QSQQTFS$_8$NLWQamLLSQN-NH2 | 9.* | | | | | | | | | | | | | |
| SP-38 | 2123.46 | Ac-QSQQTFS$_8$NamMWRLLSQN-NH2 | >50 | | | | | | | | | | | | | |
| SP-39 | 1871.14 | Ac-NlePRFS$_8$RDYWEGLSQN-NH2 | 5.2; 3.9 | | | | 3.82 | | | 0.8 | 1.5 | 1.3 | | | 62.6 | 90.6 |
| SP-40 | 1953.33 | Ac-NlePRFS$_8$NYWRLLSQN-NH2 | >50 | | | | 6.3 | | | 3.1 | 1.7 | 1 | | | | |
| SP-41 | 1578.94 | Ac-RFS$_8$NLWRLLSQ-NH2 | 14.5 | | | | | | | | | | | | | |
| SP-42 | 2161.44 | Ac-QSQQTF$_8$N2HWRLLSQN-NH2 | 18.3 | | | | | | | | | | | | | |
| SP-43 | 2161.44 | Ac-QSQQT#$_8$N3HWRLLSQN-NH2 | 14 | | | | 29.3 | 25 | 180 | | | | | | | |
| SP-44 | 2081.38 | Ac-QSCCT#$_8$NLWRLLHQN-NH2 | 32.85 | | | | | | | | | | | | | |
| SP-45 | 2061.39 | Ac-RSQQTAS$_8$NLWRLLSQN-NH2 | 6.8 | | | 175 | 10.1 | | | | | | | | 50.5 | 94.8 |
| SP-46 | 2111.45 | Ac-QSQQT#%$_8$NLWRLL%CQN-NH2 | >50 | | | | | | | | | | | | | |
| SP-47 | 2052.33 | HepCSQ#TFSNLWRLLPQN-NH2 | >50 | | | | | | | | | | | | | |
| SP-48 | 2160.56 | HepQSQ#TFS$_8$NLWRLLSQN-NH2 | | | | | | | | | | | | | 64.3, 85 | 88.5, 121 |

FIG. 6C

| SP# | MW | Sequence | SJSA-1 Cell viability EC50 (μM) serum free 24h | Competition ELISA IC50 (nM) GST-hDM2 | Competition ELISA IC50 (nM) GST-hDMX | p53 Nuclear translocation of p53 (GRIP assay) | Affinity selection M/S Kd (nM) GST-hDM2 | Affinity selection M/S Kd (nM) GST-hDMX | p21 activation ELISA 20μM | p21 activation ELISA 10μM | p21 activation ELISA 1μM | FP Competition Binding IC50 (nM) HDM2 | FP Competition Binding IC50 (nM) HDMx | CD % Helicity 0% TFE | CD % Helicity 50% TFE |
|---|---|---|---|---|---|---|---|---|---|---|---|---|---|---|---|
| SP-49 | 2143.87 | Ac-QSQQTF$r8NLL$cHYWRLL$3QN-NH2 | 15.94 | | | 11.25 | | | | | | | | 60.9 | 82.4 |
| SP-50 | 2157.90 | Ac-QSQQTF$r8NLMe$xHWRLL$3QN-NH2 | >50 | | | >50 | | | | | | | | -0.5 | 61.6 |
| SP-51 | 1535.68 | Ac-LITF$-HYWAQLT$-NH2 | >50 | | | | | | | | | | | | |
| SP-52 | 1586.83 | Ac-LITF$-HYW$QLT$-NH2 | >50 | | | | | | | | | | | | |
| SP-53 | 1521.75 | Ac-LITF$XYW$A$LT$-NH2 | >50 | | | | | | | | | | | | |
| SP-54 | 1598.88 | Ac-LITF$r8HYWAQL$-NH2 | 16.3 | | | | | | | | | | | 85.6 | 96.6 |
| SP-55 | 1683.99 | Ac-LITF$r8HYWRQL$-NH2 | 12.8 | | 38.3 | 19.3 | | | 25.2 | 15.1 | | | | 59.5 | 84.2 |
| SP-56 | 2145.53 | Ac-QS$QTF$-NLWRLL$s8QN-NH2 | >50 | | | >50 | | | 1 | 1 | | | | 98.9,109 | 110,124 |
| SP-57 | 1925.11 | Ac-QSQQT4$s8NLWRLL$RLLPQN-NH2 | >50 | | | | | | | | | | | | |
| SP-58 | 2061.39 | Ac-QSQQTA$r8NLWRLL$QN-NH2 | | | | | | | | | | | | | |
| SP-59 | 2080.43 | Ac-ASQQTF$r8NLWRLL$QN-NH2 | | | | | | | | | | | | | |
| SP-60 | 2010.30 | Ac-SSQQ$F$NLWRLL$AbQN-NH2 | | | | | | | | | | | | | |
| SP-61 | 2024.32 | Ac-QS$QTF$NLWRLL$AbQN-NH2 | 35.76 | | | | | | | | | | | | |
| SP-62 | 2025.27 | Ac-QSQQ$F$NS$NLWRLL$AbQN-NH2 | >50 | | | | | | | | | | | | |
| SP-63 | 1995.27 | Ac-QSQQTF$NLW$LL$AbQN-NH2 | >50 | | | | | | | | | | | | |
| SP-64 | 2012.27 | Ac-QSQQTF$NLWRS$LLAbQN-NH2 | >50 | | | | | | | | | | | | |
| SP-65 | 1941.19 | Ac-QSQQTF$NLW$LLA$N-NH2 | >50 | | | | | | | | | | | | |
| SP-66 | 2038.35 | Ac-$SQQTF$NLWRLLAbQN-NH2 | | | | | | | | | | | | | |
| SP-67 | 2052.38 | Ac-Q$S$QTF$NLWRLLAbQN-NH2 | 16.57 | | | | | | | | | | | | |
| SP-68 | 2053.32 | Ac-QS$Q$F$NS$NLWRLLAbQN-NH2 | 36.94 | | | | | | | | | | | | |
| SP-69 | 2024.32 | Ac-QSQQTF$NLW$LLAbQN-NH2 | >50 | | | | | | | | | | | | |
| SP-70 | 1997.30 | Ac-QSQ$TF$SLWRLLAbQN-NH2 | 36.06 | | | | | | | | | | | | |
| SP-71 | 2025.35 | Ac-QSQ$$TF$SLWRLLAbQN-NH2 | 30.36 | | | | | | | | | | | | |
| SP-72 | 2202.64 | Ac-QS$(CTFS(LWRLL$s8QN-NH2 | 5.1 | >1000 | | 10.68 | | | | | | | | 99 | 108 |

FIG. 6D

| SP# | MW | Sequence | SJSA-1 Cell viability EC50 (µM) serum free 24h | 72h | Competition ELISA IC50 (nM) GST-hDM2 | GST-hDMX | p53 Nuclear translocation of p53 (GRIP assay) | Affinity selection MS Kd (nM) GST-hDM2 | GST-hDMX | p21 activation ELISA 20µM | 10µM | 1µM | FP Competition Binding IC50 (nM) HDM2 | HDMx | CD %Helicity 0%TFE | 50%TFE |
|---|---|---|---|---|---|---|---|---|---|---|---|---|---|---|---|---|
| SP-73 | 2039.38 | Ac-Sr8SQQTFS$LWRLLAIbQN-NH2 | 14.01 and 26.91 | | | | | | | | | | | | | |
| SP-74 | 1997.30 | Ac-QSQS$8TFSNLWS\$LLAIbQN-NH2 | >50 (both) | | | | | | | | | | | | | |
| SP-75 | 2025.35 | Ac-QSQQTFS$r8LWRLLASN-NH2 | >50 | | | | | | | | | | | | | |
| SP-76 | 2033.37 | Ac-QS$\$5QTFS$NLWS\$LLAIbQN-NH2 | >50 | | | | | | | | | | | | | |
| SP-77 | 2067.43 | Ac-S\$r8SQQTFS$LWRLLAIbQN-NH2 | | | | | | | | | | | | | | |
| SP-78 | 2025.35 | Ac-S\$r8TFSNLWS\$LLAIbQN-NH2 | | | | | | | | | | | | | | |
| SP-79 | 2053.41 | Ac-QS$r8QTFS$r8LWRLLA$N-NH2 | | | | | | | | | | | | | | |
| SP-80 | 2089.48 | Ac-QS$r5QTFS\$r7NLW$\$jLLAIbQN-NH2 | | | | | | | | | | | | | | |
| SP-81 | 1989.19 | Ac-QSQQTFSNLWRLLAIbQN-NH2 | | | | | | | | | | | | | | 58 |
| SP-82 | 2216.67 | HexlQSQS$TFS\$r8NLW$\$LS\$QN-NH2 | | | | | | | | | | | | | | |
| SP-83 | 2052.38 | Ac-ASQQTFS$r8NLRWLLS$QN-NH2 | | | | | | | | | | | | | | |
| SP-84 | 2023.38 | Ac-QSQQTFS$r8NLW$LLSQ-NH2 | | | >50 | | | | | | | | | | | |
| SP-85 | 1995.33 | Ac-QSQQTFS$r8NLW$RLLSC-NH2 | 9.35 | | 20.7 | | | | | | | | | | | |
| SP-86 | 1516.79 | Ac-A-A-ARA$r8AAARA$A$AA-NH2 | | | | | | | | | | | | | | |
| SP-87 | 1607.76 | Ac-LTFEHYWAQLTSA-NH2 | | | | | | | | | | | | | | |
| SP-88 | 1669.96 | Ac-LTFS\$r8HYWAQLS$SA-NH2 | | | 6.5 | | 12.1 | | | | | 80.8 | | | | 81.8 |
| SP-89 | 1944.15 | Ac-ASQQTFSNLW$RLLPQN-NH2 | | | | | | | | | | | | | | |
| SP-90 | 2033.37 | Ac-QS$QTFS$NLW$r5LLAIbQN-NH2 | | | | | | | | | | | | | | |
| SP-91 | 1987.22 | Ac-QSQQTF\$r8bNLW$RLLAIbQN-VH2 | | | | | | | | | | | | | | |
| SP-92 | 2043.33 | Ac-QSQQTFNIeNLW$RLLNIeQN-NH2 | | | | | | | | 77.8 | | | | | | 95.7 |
| SP-93 | 2083.39 | Ac-QSQQTFS$r8NLW$RLLAIbQN-NH2 | | | | | | | | 131 | | | | | | 143 |
| SP-94 | 2111.45 | Ac-QSQQTF$r8NLW$RLLNIe2N-NH2 | | | | | | | | | | | | | | |
| SP-95 | 2041.31 | Ac-QSQQTFAIbNLW$RLLS$QN-NH2 | | | | | | | | | | | | | | |
| SP-96 | 2059.37 | Ac-QSQQTFNIeNLW$RLLS$QN-NH2 | | | | | | | | | | | | | | |

FIG. 6E

| SP# | MW | Sequence | SJSA-1 Cell viability EC50 (μM) serum free | | Competition ELISA IC50 (nM) | | p53 Nuclear translocation of p53 (GRIP assay) | Affinity selection MS Kd (nM) | | p21 activation ELISA | | | | FP Competition Binding IC50 (nM) | | CD %Helicity | |
|---|---|---|---|---|---|---|---|---|---|---|---|---|---|---|---|---|---|
| | | | 24h | 72h | GST-hDM2 | GST-hDMX | | GST-hDM2 | GST-hDMX | 20μM | 10μM | 1μM | HDM2 | HDMX | | 0%TFE | 50%TFE |
| SP-97 | 2145.89 | Ac-QSQQTF%r8NLGclwRNle_%QN-NH2 | | | | | | | | | | | | | | | |
| SP-98 | 2159.92 | Ac-QSQQTF%r8NLMe6clwRLL%QN-NH2 | | | | | | | | | | | | | | 62.4 | 71.1 |
| SP-101 | 1161.39 | Ac-FNle&YWESL-NH2 | | | | | | | | | | | | | | | |
| SP-102 | 1345.63 | Ac-F$r8AYWELL$A-NH2 | | | | | | | | | | | | | | | |
| SP-103 | 1344.64 | Ac-F$r8AYWQLL$A-NH2 | | | | | | | | | | | | | | | |
| SP-104 | 1926.26 | Ac-NlePRF$r8NYWELL$QN-NH2 | | | | | | | | | | | | | | | |
| SP-105 | 1954.32 | Ac-NlePRF$r8DYWFRLL$QN-NH2 | | | | | | | | | | | | | | | |
| SP-106 | 1839.23 | Ac-NlePRF$r8NYWRLL$Q-NH2 | | | | | | | | | | | | | | | |
| SP-107 | 1771.10 | Ac-NlePRF$r8NYWRLL$-NH2 | | | | | | | | | | | | | | 54.4 | 80.5 |
| SP-108 | 2110.41 | Ac-QSQQTF$r8DlWRLL$QN-NH2 | | | | | | | | | | | | | | | |
| SP-109 | 2110.41 | Ac-QSQQTF$r8NLWRLL$EN-NH2 | | | | | | | | | | | | | | | |
| SP-110 | 2110.41 | Ac-QSQQTF$r8NLWRLL$QD-NH2 | | | | | | | | | | | | | | | |
| SP-111 | 1954.27 | Ac-QSQQTF$r8NLWRLL$S-NH2 | | | | | | | | | | | | | | | |
| SP-112 | 2110.41 | Ac-ESQQTF$r8NLWRLL$QN-NH2 | | | | | | | | | | | | | | | |
| SP-113 | 1637.02 | Ac-LTF$r8NLWRNle$Q-NH2 | | | | | | | | | | | | | | | |
| SP-114 | 1692.10 | Ac-LRF$r8NLWRNle$SQ-NH2 | | | | | | | | | | | | | | | |
| SP-115 | 2182.48 | Ac-QSQQTF$r8NWWRNleLS$QN-NH2 | | | | | | | | | | | | | | | |
| SP-116 | 1995.33 | Ac-QSQQTF$r8NLWRNleL$Q-NH2 | | | | | | | | | | | | | | | |
| SP-117 | 1756.09 | Ac-QTF$r8NLWRNleL$QN-NH2 | | 4.1 | | | | | | | | | | | | | |
| SP-118 | 1976.37 | Ac-NlePRF$r8NWWRLL$QN-NH2 | | | | | | | | | | | | | | | |
| SP-119 | 1805.22 | Ac-NlePRF$r8NWAWRLL$A-NH2 | | | | | | | | | | | | | | | |
| SP-120 | 1468.61 | Ac-T$r8AEYWNLL$P-NH2 | | | | | | | | | | | | | | 6.8 | 30.6 |
| SP-121 | 1652.89 | Ac-QTF$r8HWWSQLL$S-NH2 | | | | | | | | | | | | | | 21.6 | 88.2 |
| SP-122 | 1179.43 | Ac-FM$YWESL-NH2 | | | | | | | | | | | | | | | |
| SP-123 | 1602.75 | Ac-QTFEHWWSQLL$A-NH2 | | | | | | | | | | | | | | 21.6 | 87.6 |

FIG. 6F

| SP# | MW | Sequence | SJSA-1 Cell viability EC50 (μM) serum free 24h | 72h | Competition ELISA IC50 (nM) GST-hDM2 | GST-hDMX | p53 Nuclear translocation of p53 (GRIP assay) | Affinity selection MS Kd (nM) GST-hDM2 | GST-hDMX | p21 activation ELISA 20μM | 10μM | 1μM | FP Competition Binding IC50 (nM) HDM2 | HDMx | CD %Helicity 0%TFE | 50%TFE |
|---|---|---|---|---|---|---|---|---|---|---|---|---|---|---|---|---|
| SP-124 | 2123.46 | Ac-QSQQTF$%r8NLAnwRLNI$QN-NH2 | | | | | | | | | | | | | -3.6 | 16.3 |
| SP-125 | 1131.73 | Ac-FMAibY6clMEAc3cL-NH2 | | | | | | | | | | | | | | |
| SP-126 | 1195.84 | Ac-FNIeSY6clMEBL-NH2 | | | | | | | | | | | | | 4.6 and 2.3 | 58.1 |
| SP-127 | 1278.92 | Ac-F$r8AY6clWEAc3cL$-NH2 | | | | | | | | | | | | | | |
| SP-128 | 1350.00 | Ac-F$r8AY6clWEAc3cL$A-NH2 | | | | | | | | | | | | | | |
| SP-129 | 1987.78 | Ac-NIePRF$r8NY6clWRLLSQN-NH2 | | | | | | | | | | | | | | |
| SP-130 | 1224.49 | Ac-AF$r8AAWALA$A-NH2 | | | | | | | | | | | | | | |
| SP-131 | 1396.68 | Ac-TF$r8AAWRLASQ-NH2 | | | | | | | | | | | | | | |
| SP-132 | 1410.70 | Pr-TF$r8AAWRLASQ-NH2 | | | | | | | | | | | | | | |
| SP-133 | 2111.45 | Ac-QSQQTF%r8NLWRNIeL%cQN-NH2 | | | | | | | | | | | | | 84.7 | 110.8 |
| SP-134 | 1671.98 | Ac-LTF%r8HYWAQL%S$A-NH2 | | | | | | | | | | | | | 78.4 | 82 |
| SP-135 | 1955.35 | Ac-NIePRF%r8NYWRLL%QN-NH2 | | | | | | | | | | | | | 61.6 | 84.8 |
| SP-136 | 1989.80 | Ac-NIePRF%r8NY6clWRLL%QN-NH2 | 2.6 | | | | | | | | | | | | | |
| SP-137 | 1635.34 | Ac-LTF%r8HY6clWAQL%S-NH2 | 2 | | | | | | | | | | | | 69.5 | 78.6 |
| SP-138 | 2150.56 | Ac-QS%QTF%r8NLWRLL%s$QN-NH2 | | | | | | | | | | | | | 96 | 101.3 |
| SP-139 | 1720.45 | Ac-LTF%r8HY6clWRQL%S-NH2 | | | | | | | | | | | | | 74.2 | 94.2 |
| SP-140 | 2145.88 | Ac-QSQQTF%r8NL6clWRLL%QN-NH2 | 0.65 | | | | | | | | | | | | 92.4 | 120.8 |
| SP-141 | 2041.40 | Ac-%r8SQQTF$%LWRLLAibQN-NH2 | | | | | | | | | | | | | 66.7 | 105.6 |
| SP-142 | 1600.90 | Ac-LTF%r8HYWAQL%S-NH2 | | | | | | | | | | | | | 45.2 | 44.7 |
| SP-143 | 1603.90 | Ac-TSF%r8QYWNLL%P-NH2 | | | | | | | | | | | | | 2.6 | 26.5 |

FIG. 7A

| SP# | SEQUENCE | | | | | | | | | | FP Competition Binding Assay | | | SJSA-1 Cell Viability 72h (10% FBS) EC50 (uM) | | p21 levels at 21h (10% FBS) (pg/ml) | | | |
|---|---|---|---|---|---|---|---|---|---|---|---|---|---|---|---|---|---|---|---|
| | | | | | | | | | | | HDM2 IC50 (nM) | HDMx IC50 (nM) | HDM2 Ki (IC50) - FAM-pDi | HDMx Ki (IC50) - FAM-pDi | AVE EC50 (uM) | SD | 30uM | 10uM | 3uM | 1uM |
| Nutlin 3a | Ac- | Q | S | Q | T | F | $r8 | N | L | W | R | L | $s | Q | N-NH2 | 442 | 42500 | 82.3 | 6875 | 1.6 | 0.55 | 3293±619 | 2659±749 | 915±262 | BDL |
| SP-5 | | | | | Ac- | F | $r8 | A | Y | 6clW | E | Ac3c | $s | A-NH2 | | 94.1 | 667 | 14 | 91 | >30 | | ND | ND | ND | ND |
| SP-128 | | | | Ac- | T | F | $r8 | H | Y | W | A | Q | $s | S-NH2 | | 114.5 | 967 | 2.5 | 85.1 | 4.5 | 1.70 | 2400±584 | 1535±186 | 522±82 | BDL |
| SP-142 | | | | Ac- | T | F | $r8 | A | Y | W | A | Q | $s | S-NH2 | | 88.13 | 408 | 4.5 | 63.9 | 14.2 | 5.40 | 2398 | 170 | BDL | BDL |
| SP-191 | | | | Ac- | T | F | $r8 | H | Y | W | A | Q | $s | A-NH2 | | 74.92 | 97 | 8.4 | ND | 5.7 | 0.80 | 1672±267 | 1068±93 | 105±79 | BDL |
| SP-194 | | | | Ac- | T | F | $r8 | A | Y | W | A | Q | $s | A | | 140.55 | 463 | 9.1 | nD | 5.2 | 1.00 | 1723±494 | 937±117 | 178±88 | BDL |
| SP-344 | | | | Ac- | T | F | $r8 | H | Y | W | A | Q | $s | S-NH2 | | 59.41 | 348 | 5.2 | nD | 7.4 | 1.20 | 1688±443 | 1009±668 | BDL | BDL |
| SP-266 | | | | Ac- | T | F | $r8 | V | Y | W | S | Q | $s | S-NH2 | | 66 | 301 | 7 | 80 | 4.9 | 0.50 | 3751±942 | 1620±552 | 102±45 | BDL |
| SP-267 | | | | Ac- | T | F | $r8 | F | Y | W | A | Q | $s | S-NH2 | | 190.5 | 318.5 | 21 | 85 | 5.3 | 1.27 | 3933±957 | 1106±519 | 43±19 | BDL |
| SP-360 | | | | Ac- | T | F | $r8 | A | Y | W | A | A | $s | S-NH2 | | 90 | 110 | <1 | 27 | 5.0 | 2.36 | 3337±836 | 1182±509 | 265±38 | BDL |
| SP-512 | | | | Ac- | T | F | $r8 | E | Y | W | A | Q | $s | S-NH2 | | 16.2 | 26.1 | 1.86 | 4.76 | 11.3 | 3.59 | 3137±630 | 879±289 | BDL | BDL |
| SP-508 | | | | Ac- | E | F | $r8 | A | Y | W | A | Q | $s | A-NH2 | | 22.76 | 88.82 | 2.18 | 15.12 | 7.1 | 3.00 | 2322±572 | 972±182 | 451±103 | BDL |
| SP-522 | | | | Ac- | | F | $r8 | A | Y | 6clW | A | A | $s | A-NH2 | | ND | ND | ND | ND | 1.88 | 0.82 | 1117±267 | 1038±184 | 1023±205 | BDL |
| SP-580 | | | mcP EG3- | | | F | $r8 | A | Y | W | A | A | $s | S-NH2 | | 81 | 195 | 10 | 24 | 8.6 | 2.8 | 505±70 | (592,169) | BDL | BDL |
| SP-523 | | | | Ac- | | F | $r8 | A | Y | dl6br W | E | A | $s | A-NH2 | | ND | ND | ND | ND | 6.14 | 2.47 | 1016±280 | 407±25 | 41±26 | BDL |
| SP-573 | | | | Ac- | | F | $r8 | A | Y | 6clW | E | A | $s | A-NH2 | | ND | ND | ND | ND | 1.44 | 0.74 | 1103±319 | 1118±298 | 709±217 | BDL |
| SP-256 | | | | Ac- | W | T | $r8 | H | Y | W | A | L | $s | S-NH2 | | 185 | 204 | 201 | 54 | 6.7 | 3.3 | 3625±856 | 330±112 | BDL | BDL |
| SP-351 | | | | Ac- | | T | $r8 | A | Y | W | A | L | $s | S-NH2 | | 47.2 | 143 | <10 | 24.1 | 0.7 | 0.44 | 1784 | 1860 | 1184±756 | 132 |
| SP-641 | | | | Ac- | | F | $r8 | A | Y | 6clW | Q | A | $s | A-NH2 | | ND | ND | ND | ND | 2.7 | 0.23 | 1755 | 988 | 497 | 75 |

FIG. 7B

| SP# | | | SEQUENCE | | | | | | | | | | | Fold Caspase Activation relative to DMSO in 10% FBS @ 48h | | | | Cell Viability (10% FBS) EC50 (µM) | | | | % Helicity @ 222 nM vs parent seq | |
|---|---|---|---|---|---|---|---|---|---|---|---|---|---|---|---|---|---|---|---|---|---|---|---|
| | | | | | | | | | | | | | | 30uM | 10uM | 3uM | 1uM | RKO (72h) | HCT-116, 5k/well (72h) | MCF-7 (7500 cells/well, 5day) | SW-480, 2k/well, 6d | RKO-E6 (72h) | 0% TFE | 50% TFE |
| Nutlin 3a | Ac- | Q | S | Q | Q | T | F | Sr8 | N | L | W | R | L | L | S | Q | N | -NH2 | 45.5 | 26.5 | 13.3 | 1.0 | 6.7±2.5 | 8.9±4.9 | 5±1.9 | >30 | >30 | | |
| SP-5 | | | | | | | | | | | | | | | ND | ND | ND | ND | ND | ND | ND | ND | ND | 74% | 100% |
| SP-128 | | Ac- | | | | T | F | Sr8 | A | Y | 6clW | E | AC3 | L | S | A | -NH2 | | 29.6 | 9.1 | 2.0 | 1.0 | 20.8±10.5 | >30 | 10.7±0.4 | >30 | >30 | 10% | 188% |
| SP-142 | | Ac- | | | L | T | F | Sr8 | A | H | W | A | Q | L | S | S | -NH2 | | 30.0 | 2.0 | 1.7 | 1.0 | 12.6±1.6 | 24.1±4.3 | ND | 26.7 | >30 | 94% | 94% |
| SP-191 | | Ac- | | | L | T | F | Sr8 | A | Y | W | A | Q | L | S | S | -NH2 | | 34.5 | 5.1 | 1.8 | 1.0 | 10.6±3.8 | 11.1±2.4 | 6.4±1.2 | >30 | >30 | 4% | 151% |
| SP-194 | | Ac- | | | L | T | F | Sr8 | A | H | Y | A | Q | L | S | A | -NH2 | | 32.6 | 5.8 | 2.2 | 1.0 | ND | 11.2±6.5 | 4±0.4 | >30 | >30 | 5% | 143% |
| SP-344 | | Ac- | | | L | T | F | Sr8 | A | Y | W | A | Q | L | S | A | A | | 38.8 | 5.3 | 1.6 | 1.0 | 15.3±5.1 | 11.3±3.7 | 10.2±1.6 | >30 | >30 | 140% | 140% |
| SP-266 | | Ac- | | | L | T | F | Sr8 | A | V | W | A | Q | L | S | S | -NH2 | | 30±0 | 12±11 | 1±0 | 1.0 | 16±2 | 7.5±0.85 | ND | 19.2±2.7 | >30 | 2% | 142% |
| SP-267 | | Ac- | | | L | T | F | Sr8 | A | F | Y | A | Q | L | S | S | -NH2 | | 29±4 | 15±8 | 1±0 | 1.0 | 9.5±2.5 | 5.5±0.5 | ND | 17.5±7.3 | ~25uM | 1% | 120% |
| SP-360 | | Ac- | | | L | T | F | Sr8 | A | F | W | A | Q | L | F | S | -NH2 | | 30±4 | 1'±8 | 2±1 | 1.0 | 5.5±0.7 | 6.6 | ND | >30 | >30 | 8% | 119% |
| SP-512 | | Ac- | | | L | T | F | Sr8 | A | E | Y | A | Q | L | L | S | -NH2 | | 24±6 | 1'±2 | 3±0 | 1.0 | >30 | ND | ND | >30 | >30 | 2% | 131% |
| SP-508 | | Ac- | | | L | T | F | Sr8 | A | Y | W | E | A | L | S | S | -NH2 | | 19±6 | 8±4 | 4±2 | 1.0 | >30 | 27.1±5.1 | ND | >30 | >30 | 8% | 126% |
| SP-522 | | Ac- | | | E | T | F | Sr8 | A | Y | 6clW | A | Q | L | S | A | -NH2 | | 27±1.7 | 17±2.2 | 5±1 | 1.0 | >30 | 13±5.8 | ND | >30 | >30 | 5% | 127% |
| SP-580 | | | TdP-E33- | L | T | F | Sr8 | A | Y | W | E | A | L | S | S | -NH2 | | | 16±2.4 | 8±0.1 | 1±0.5 | 1.0 | 11.7±1 | 26.3±1.7 | ND | 26.4uM±4.8 | >30 | 5% | 134% |
| SP-523 | | | | | | T | F | Sr8 | A | Y | d6brW | E | A | L | S | S | -NH2 | | 19±1 | 4±0.5 | 1±0.1 | 1.0 | >30 | >30 | ND | 4.46 | >30 | ND | ND |
| SP-573 | | Ac- | | | T | F | Sr8 | A | Y | 6clW | E | A | L | S | A | -NH2 | | | 23±12 | 16±1.8 | 6±2 | 1.0 | 25±8.6 | 16.8uM±6.2 | ND | 26.4uM±4.8 | 9.07 | ND | ND |
| SP-256 | | Ac- | W | T | F | Sr8 | A | Y | W | A | Q | L | S | S | -NH2 | | | | 36±2 | 4±5 | 1±0 | 1.0 | 2.25uM±7.7 | 1.11 | ND | 4.46 | | ND | ND |
| SP-351 | | Ac- | L | T | F | Sr8 | A | H | Y | A | Q | L | S | S | -NH2 | | | | 31 | 29 | 15±5.5 | 2 | 1.73 | 28.25±12.52 | ND | | | ND | ND |
| SP-641 | | Ac- | | | T | F | Sr8 | A | Y | 6clW | Q | A | L | S | A | -NH2 | | | 20 | 13 | 6±1.8 | 1 | 25.49 | | ND | | | ND | ND |

FIG. 7C

| SP# | SEQUENCE | | | | | | | | | FP Competition Binding Assay | | | | SJSA-1 Cell Viability 72h (10% FBS) EC50 (uM) | | p21 levels at 21h (10% FBS) (pg/ml) | | | |
|---|---|---|---|---|---|---|---|---|---|---|---|---|---|---|---|---|---|---|---|
| | | | | | | | | | | HDM2 IC50 (nM) | HDMx IC50 (nM) | HDM2 Ki (IC50) - FAM-pDi | HDMx Ki (IC50) - FAM-pDi | AVE EC50 (uM) | SD | 30uM | 10uM | 3uM | 1uM |
| SP-684 | Ac- | L | T | F | Sr8 | F | Y | A | Q | L | S | -NH2 | 103.6 | 442 | <10 | 74.6 | 2.7 | 0.00 | 1687 | 553 | 51 | 25 |
| SP-681 | Ac- | L | T | F | Sr8 | A | Y | V | Q | L | S | -NH2 | 118 | 395 | <10 | 66.8 | 2.8 | 0.14 | 1983 | 368 ± 290 | 57 | 76 |
| SP-686 | Ac- | F | T | F | Sr8 | F | Y | A | Q | L | S | -NH2 | 102.5 | 269 | <10 | 45.4 | 3.6 | 0.63 | 1798 | 196 | 0 | BDL |
| SP-688 | Ac- | L | T | F | Sr8 | A | H | A | Q | L | S | -NH2 | 77.1 | 293.2 | <10 | 49.5 | 3.6 | 2.26 | 1282 | 398 | 6 | BDL |
| SP-671 | Ac- | L | T | F | Sr8 | E | Y | A | Q | L | S | -NH2 | 63.6 | 110 | <10 | 18.6 | 3.7 | 0.69 | 1398 | 372 | 86 | 11 |
| SP-485 | Ac- | L | T | F | Sr8 | A | Y | A | Q | L | A | -NH2 | ND | ND | ND | ND | 3.9 | 0.50 | 1604 | 1125 | 208 | 38 |
| SP-604 | Ac- | L | T | F | Sr8 | F | Y | A | Q | L | A | -NH2 | 115 | 309.5 | <10 | 52.3 | 3.9 | 0.97 | 2183 | 254 | -6 | BD_E |
| SP-685 | Ac- | L | T | F | Sr8 | L | Y | S | Q | L | A | -NH2 | 97.9 | 491 | <10 | 83 | 4.0 | 2.68 | 1442 | 225 | 12 | 18 |
| SP-698 | Ac- | L | T | F | Sr8 | A | Y | S | Q | L | A | -NH2 | 82.2 | 156.7 | <10 | 26.5 | 4.4 | 0.90 | 1574 | 530 | 88 | 42 |
| SP-586 | Ac- | L | T | F | Sr8 | A | Y | A | Q | F | S | -NH2 | 111 | 673 | <10 | 13.7 | 4.7 | 1.53 | 2259 | 516 | 0 | BDL |
| SP-585 | Ac- | L | T | F | Sr8 | A | Y | A | Q | Cba | S | -NH2 | 92 | 282 | <10 | 47.7 | 5.0 | 1.63 | 2112 | 739 ± 305 | 32 | 51 |
| SP-623 | Ac- | L | T | F | Sr8 | V | Y | A | A | L | S | -NH2 | 68.3 | 251 | <10 | 42.4 | 5.1 | 1.23 | 2343 | 1701 ± 667 | 41 | 0 |
| SP-673 | Ac- | I | T | F | Sr8 | F | Y | A | Q | L | A | -NH2 | 135.6 | 717 | 11 | 121 | 6.5 | 0.59 | 1693 | 606 | 80 | 0 |
| SP-714 | | Ac- | F | Sr8 | A | Y | 6clW | S | Q | L | A | -NH2 | ND | ND | ND | ND | 5.5 | 1.44 | 2064 ± 24 | 1284 ± 155 | 249 ± 46 | 15 ± 21 |
| SP-352 | Ac- | L | V | F | Sr8 | A | Y | A | Q | L | S | -NH2 | 80.9 | 386 | <10 | 65.3 | 5.8 | 2.58 | 1535 ± 143 | 1028 ± 439 | 56 ± 37 | 0 ± 0 |
| SP-709 | Ac- | L | E | F | Sr8 | A | Y | A | Q | L | A | -NH2 | 103 | 235 | <10 | 39.7 | 5.8 | 3.05 | 1574 ± 47 | 787 ± 149 | 218 ± 27 | 55 ± 37 |
| SP-643 | Ac- | L | T | F4F | Sr8 | A | Y | A | Q | L | S | -NH2 | ND | ND | ND | ND | 6.0 | 0.20 | 2137 ± 287 | 1343 ± 303 | 51 ± 44 | 6 ± 8 |
| SP-566 | Ac- | L | T | F | Sr8 | A | Y | A | Q | L | S | -NH2 | ND | ND | ND | ND | 6.1 | 1.35 | 2243 ± 84 | 1111 ± 29 | 24 ± 3 | 4 ± 6 |
| SP-696 | Ac- | W | T | F | Sr8 | L | Y | S | Q | L | S | -NH2 | 105 | 379 | <10 | 64 | 6.2 | 0.45 | 2777 ± 162 | 247 ± 365 | 0 ± 0 | 0 ± 0 |

FIG. 7D

| SP# | SEQUENCE | | | | | | | | | | Fold Caspase Activation relative to DMSO in 10% FBS @ 48h | | | | Cell Viability (10% FBS) EC50 (µM) | | | | % Helicity @ 222 nM vs parent seq | |
|---|---|---|---|---|---|---|---|---|---|---|---|---|---|---|---|---|---|---|---|---|
| | | | | | | | | | | | 30uM | 10uM | 3uM | 1uM | RKO (72h) | HCT-116 5k/well (72h) | MCF-7 (7500 cells/well, 5 day) | SW-480 2k/well, 6d | RKO-E6 (72h) | 0% TFE | 50% TFE |
| SP-684 | Ac- | L | T | F S8 | F | Y | W | A | Q | L | S | -NH2 | 24 | 9 ± 6.0 | 1 | 1 | 11.26 | 9.37 | NC | 12.4 ± 4.56 | 27.63 | ND | ND |
| SP-681 | Ac- | L | T | F S8 | A | Y | W | V | Q | L | S | -NH2 | 23 | 5 | 1 | 1 | 12.89 | 10.83 ± 5.46 | NC | 9.40 ± 3.10 | 24.07 ± 8.49 | ND | ND |
| SP-686 | Ac- | F | T | F S8 | F | Y | W | A | Q | L | S | -NH2 | 24 | 2 | 1 | 1 | 1.12 | 2.1 | ND | 11.84 ± 5.19 | >30 | ND | ND |
| SP-688 | Ac- | L | T | F S8 | A | H | W | A | Q | L | S | -NH2 | 17 | 6 | 1 | 1 | 23.86 ± 9.66 | 14.55 | ND | >30 | 28.12 | ND | ND |
| SP-671 | Ac- | L | T | F S8 | E | Y | W | A | Q | L | S | -NH2 | 19 | 4 | 1 | 1 | >30 | 15.59 | ND | >30 | >30 | ND | ND |
| SP-495 | Ac- | L | T | F S8 | A | Y | W | A | Q | L | A | A -NH2 | 22 | 19 | 3 | 1 | 5.84 | 4.78 | ND | 13.83 | 29.88 | ND | ND |
| SP-604 | Ac- | L | T | F S8 | F | Y | W | A | Q | L | A | -NH2 | 28 | 2 | 1 | 1 | 5.3 ± 4.1 | 5.6 ± 2.6 | ND | 9.3 ± 4 | 14.4 ± 8.1 | ND | ND |
| SP-685 | Ac- | L | T | F S8 | L | Y | W | S | Q | L | A | -NH2 | 17 | 2 | 1 | 1 | 30.24 ± 4.25 | 7.32 ± 4.75 | ND | 15.82 | >30 | ND | ND |
| SP-698 | Ac- | L | T | F S8 | A | Y | W | S | Q | L | S | -NH2 | 21 | 8 | 1 | 1 | 12.08 ± 4.57 | 4.05 | ND | >30 | >30 | ND | ND |
| SP-586 | Ac- | L | T | F S8 | A | Y | W | A | Q | F | S | -NH2 | 20 | 5 | 1 | 1 | 25.03 ± 4.46 | 11.05 | ND | 5.79 | >30 | ND | ND |
| SP-585 | Ac- | L | T | F S8 | A | Y | W | A | Cba | a | S | -NH2 | 22 | 7 | 1 | 1 | 9.79 ± 4.47 | 9.55 | ND | 17.68 | >30 | ND | ND |
| SP-623 | Ac- | L | T | F S8 | V | Y | W | A | A | L | S | -NH2 | 21 | 15 | 1 | 1 | 7.37 | 7.5 | NC | 10.51 | 24.2 | ND | ND |
| SP-673 | Ac- | L | T | F S8 | A | Y | W | A | A | L | A | -NH2 | 25 | 9 ± 5.3 | 1 ± 0 | 1 ± 0 | 8.08 | 6.93 | NC | 16.94 ± 5.95 | 27.98 | ND | ND |
| SP-714 | | | | Ac- | F S8 | A | Y | 6clW | S | A | L | S -NH2 | 33 ± 1.3 | 16 ± 1.9 | 2 ± 0.3 | 1 ± 0 | 4.4 ± 1.7 | 7.6 ± 3.6 | NC | 13.7 ± 0.9 | >30 | ND | ND |
| SP-352 | Ac- | V | T | F S8 | A | Y | W | S | A | L | A | -NH2 | 13 ± 1.2 | 11 ± 1.5 | 1 ± 0.2 | 1 ± 0.1 | 5.6 ± 0.3 | 5 ± 0.3 | NC | 4.6 ± 1.6 | 10.4 ± 1.8 | ND | ND |
| SP-709 | Ac- | L | T | F S8 | A | Y | W | A | Q | L | A | -NH2 | 25 ± 0.1 | 11 ± 2.3 | 2 ± 0.4 | 1 ± 0.1 | 29.2 ± 3.3 | >30 | NC | >30 | >30 | ND | ND |
| SP-643 | Ac- | L | E | F S8 | A | Y | W | A | Q | L | S | -NH2 | 29 ± 2.2 | 16 ± 7.2 | 1 ± 0.1 | 1 ± 0.1 | 8.6 ± 1.8 | 7.1 ± 0.3 | NC | 17.1 ± 8.5 | >30 | ND | ND |
| SP-566 | Ac- | L | F4 | F S8 | A | Y | W | A | Q | L | S | -NH2 | 28 ± 2.6 | 17 ± 2.9 | 1 ± 0.1 | 1 ± 0.1 | 5.6 ± 3.6 | 9.1 ± 0 | NC | 9.8 ± 3.2 | 27.3 ± 3.1 | ND | ND |
| SP-696 | Ac- | W | T | F S8 | L | Y | W | S | Q | L | S | -NH2 | 26 ± 0.2 | 4 ± 4.8 | 1 ± 0 | 1 ± 0 | 9.1 ± 4.5 | 11.8 ± 4.9 | NC | 10 ± 4.3 | 29.8 ± 0.2 | ND | ND |

SP-142 in the SJSA-1 Xenograft Model in Nude Mice: Tumor Volume

| Group No. | Treatment | Amount/dose (mg/kg) | Schedule | ROA | TGI (%) after 13 days dosing |
|---|---|---|---|---|---|
| 1 | Vehicle control | - | qd | ip | - |
| 2 | Small molecule inhibitor control | 50 | qd | po | > 100% |
| 3 | SP-142 | 5 | qd | ip | 27% |
| 4 | SP-142 | 10 | qd | ip | 4.5% |
| 5 | SP-142 | 20 | qd | ip | 34% |

SP-190 & SP-343 in the SJSA-1 Xenograft Model in Nude Mice: Tumor Volume

| Group No. | Treatment | Amount/dose (mg/kg) | Schedule | ROA | TGI (%) after 13 days dosing |
|---|---|---|---|---|---|
| 1 | Vehicle control | - | qd | ip | - |
| 2 | Small molecule inhibitor control | 25 | qd | po | 97% |
| 3 | SP-190 | 40 | qd | ip | 58% |
| 4 | SP-343 | 40 | qd | ip | 30% |

PEPTIDOMIMETIC MACROCYCLES

CROSS-REFERENCE TO RELATED APPLICATIONS

This application is a Continuation of U.S. application Ser. No. 14/460,848 filed Aug. 15, 2014 which is a divisional of U.S. application Ser. No. 13/816,880, filed Feb. 13, 2013 (or Apr. 25, 2013, which is the 371 date), which is a national stage of PCT/US2011/047692, filed Aug. 13, 2011, which claims the benefit of U.S. Provisional Application Nos. 61/373,701, filed Aug. 13, 2010, 61/373,638, filed Aug. 13, 2010, and 61/374,163, filed Aug. 16, 2010, each of which are hereby incorporated by reference in their entirety.

SEQUENCE LISTING

The instant application contains a Sequence Listing which has been submitted in ASCII format via EFS-Web and is hereby incorporated by reference in its entirety. Said ASCII copy, created on Jul. 31, 2013, is named 35224-757.831_SL.txt and is 586,330 bytes in size.

BACKGROUND OF THE INVENTION

The human transcription factor protein p53 induces cell cycle arrest and apoptosis in response to DNA damage and cellular stress, and thereby plays a critical role in protecting cells from malignant transformation. The E3 ubiquitin ligase HDM2 negatively regulates p53 function through a direct binding interaction that neutralizes the p53 transactivation activity, leads to export from the nucleus of p53 protein, and targets p53 for degradation via the ubiquitylation-proteasomal pathway. Loss of p53 activity, either by deletion, mutation, or HDM2 overexpression, is the most common defect in human cancers. Tumors that express wild type p53 are vulnerable to pharmacologic agents that stabilize or increase the concentration of active p53. In this context, inhibition of the activities of HDM2 has emerged as a validated approach to restore p53 activity and resensitize cancer cells to apoptosis in vitro and in vivo. HDMX (HDM4) has more recently been identified as a similar negative regulator of p53, and studies have revealed significant structural homology between the p53 binding interfaces of HDM2 and HDMX.

The p53-HDM2 and p53-HDMX protein-protein interactions are mediated by the same 15-residue alpha-helical transactivation domain of p53, which inserts into hydrophobic clefts on the surface of HDM2 and HDMX. Three residues within this domain of p53 (F19, W23, and L26) are essential for binding to HDM2 and HDMX. The present invention provides p53-based peptidomimetic macrocycles that modulate the activities of p53 by inhibiting the interactions between p53 and HDM2, p53 and HDMX, or p53 and both HDM2 and HDMX proteins, and that may be used for treating diseases including but not limited to cancer and other hyperproliferative diseases.

SUMMARY OF THE INVENTION

Described below are stably cross-linked peptides related to a portion of human p53 ("p53 peptidomimetic macrocycles"). These cross-linked peptides contain at least two modified amino acids that together form an intramolecular cross-link that can help to stabilize the alpha-helical secondary structure of a portion of p53 that is thought to be important for binding of p53 to HDM2 and for binding of p53 to HDMX. Accordingly, a cross-linked polypeptide described herein can have improved biological activity relative to a corresponding polypeptide that is not cross-linked. The p53 peptidomimetic macrocycles are thought to interfere with binding of p53 to HDM2 and/or of p53 to HDMX, thereby liberating functional p53 and inhibiting its destruction. The p53 peptidomimetic macrocycles described herein can be used therapeutically, for example to treat cancers and other disorders characterized by an undesirably low level or a low activity of p53, and/or to treat cancers and other disorders characterized by an undesirably high level of activity of HDM2 or HDMX. The p53 peptidomimetic macrocycles may also be useful for treatment of any disorder associated with disrupted regulation of the p53 transcriptional pathway, leading to conditions of excess cell survival and proliferation such as cancer and autoimmunity, in addition to conditions of inappropriate cell cycle arrest and apoptosis such as neurodegeneration and immunedeficiencies. In some instances, the p53 peptidomimetic macrocycles bind to HDM2 (e.g., GenBank® Accession No.: 228952; GI:228952) and/or HDMX (also referred to as HDM4; GenBank® Accession No.: 88702791; GI:88702791).

In one aspect, the present invention provides a peptidomimetic macrocycle comprising an amino acid sequence which is at least about 60%, 80%, 90%, or 95% identical to an amino acid sequence chosen from the group consisting of the amino acid sequences in Table 1, 2, 3, or 4. Alternatively, an amino acid sequence of said peptidomimetic macrocycle is chosen from the group consisting of the amino acid sequences in Table 1. Alternatively, an amino acid sequence of said peptidomimetic macrocycle is chosen as above, and further wherein the macrocycle does not include a thioether or a triazole. In some embodiments, the peptidomimetic macrocycle comprises a helix, such as an α-helix. In other embodiments, the peptidomimetic macrocycle comprises an α,α-disubstituted amino acid. A peptidomimetic macrocycle of the invention may comprise a crosslinker linking the α-positions of at least two amino acids. At least one of said two amino acids may be an α,α-disubstituted amino acid.

In some embodiments, the peptidomimetic macrocycle has the formula:

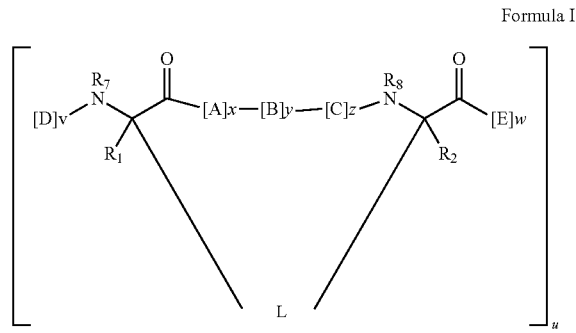

Formula I wherein:

each A, C, D, and E is independently a natural or non-natural amino acid, and the terminal D and E independently optionally include a capping group;

B is a natural or non-natural amino acid, amino acid analog,

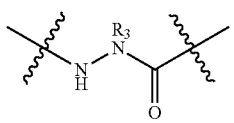

[—NH-L$_3$-CO—], [—NH-L$_3$-SO$_2$—], or [—NH-L$_3$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

L is a macrocycle-forming linker of the formula -L$_1$-L$_2$-;

L$_1$ and L$_2$ are independently alkylene, alkenylene, alkynylene, heteroalkylene, cycloalkylene, heterocycloalkylene, cycloarylene, heterocycloarylene, or [—R$_4$—K—R$_4$-]$_n$, each being optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v and w are independently integers from 1-1000;

u is an integer from 1-10;

x, y and z are independently integers from 0-10; and n is an integer from 1-5.

In various embodiments, the peptidomimetic macrocycle includes L$_1$ and L$_2$ wherein L$_1$ and L$_2$ either alone or in combination do not include a thioether or a triazole.

In other embodiments, the peptidomimetic macrocycle may comprise a crosslinker linking a backbone amino group of a first amino acid to a second amino acid within the peptidomimetic macrocycle. For example, the invention provides peptidomimetic macrocycles of the formula (IV) or (IVa):

Formula (IV)

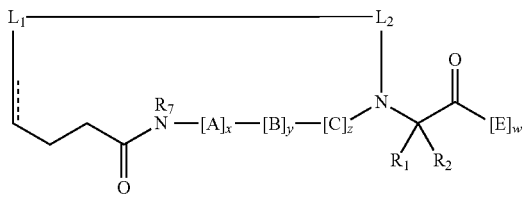

Formula (IVa)

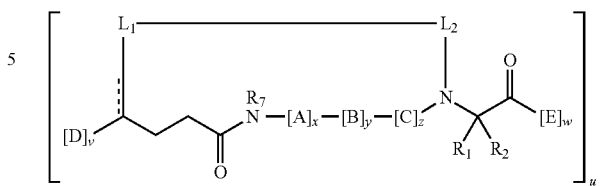

wherein:

each A, C, D, and E is independently a natural or non-natural amino acid, and the terminal D and E independently optionally include a capping group;

B is a natural or non-natural amino acid, amino acid analog,

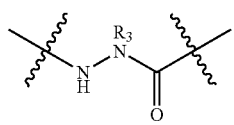

[—NH-L$_3$-CO—], [—NH-L$_3$-SO$_2$—], or [—NH-L$_3$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-, or part of a cyclic structure with an E residue;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

L$_1$ and L$_2$ are independently alkylene, alkenylene, alkynylene, heteroalkylene, cycloalkylene, heterocycloalkylene, cycloarylene, heterocycloarylene, or [—R$_4$—K—R$_4$-]$_n$, each being optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$;

V and w are independently integers from 1-1000;

u is an integer from 1-10;

x, y and z are independently integers from 0-10; and n is an integer from 1-5.

Additionally, the invention provides a method of treating cancer in a subject comprising administering to the subject a peptidomimetic macrocycle of the invention. Also provided is a method of modulating the activity of p53 or HDM2 or HDMX in a subject comprising administering to the subject a peptidomimetic macrocycle of the invention, or a method of antagonizing the interaction between p53 and HDM2 and/or HDMX proteins in a subject comprising administering to the subject such a peptidomimetic macrocycle.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIGS. 6a-f describe the results of a cell viability assay, a competition ELISA assay, GRIP assay, Kd data, p21 activation assay, fluorescence polarization competition binding and circular helicity data for exemplary peptidomimetic macrocycles of the invention (SEQ ID NOS 38-178, respectively, in order of appearance).

FIGS. 7A-D provide data from a variety of macrocycles FIGS. 7A-7B disclose SEQ ID NOS 42, 163, 177, 214, 217, 344, 289-290, 383, 533, 529, 543, 601, 544, 594, 279, 374 and 660, respectively in order of appearance, and FIGS. 7C-7D disclose SEQ ID NOS 702, 699, 704, 706, 689, 507, 624, 703, 716, 606, 605, 642, 691, 731, 375, 727, 662, 587 and 714, respectively in order of appearance).

DETAILED DESCRIPTION OF THE INVENTION

Figure 1:
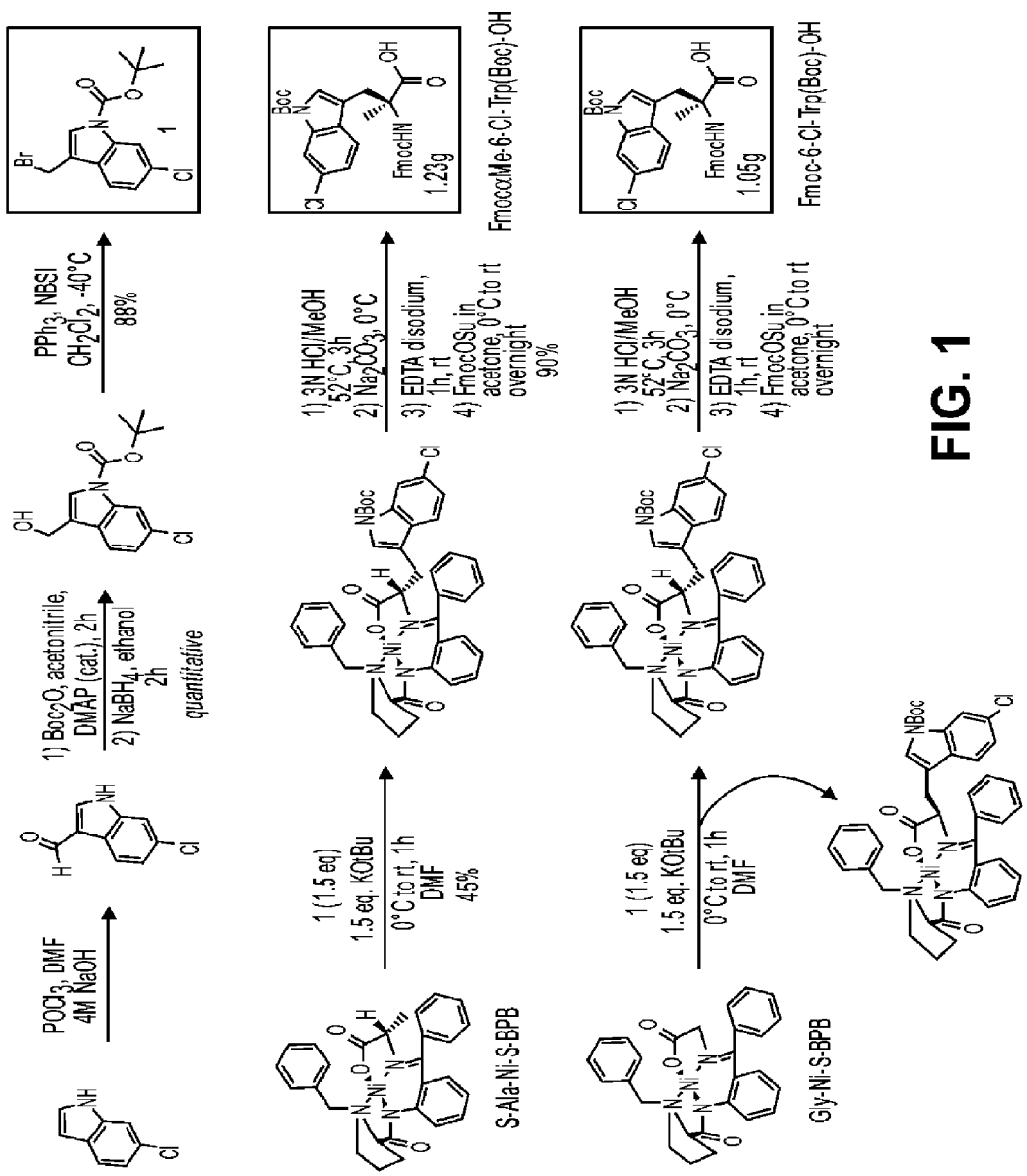
FIG. 1 describes the synthesis of Fmoc-Me-6-Chloro-Tryptophan & Fmoc-6-Chloro-Tryptophan.
Figure 2:
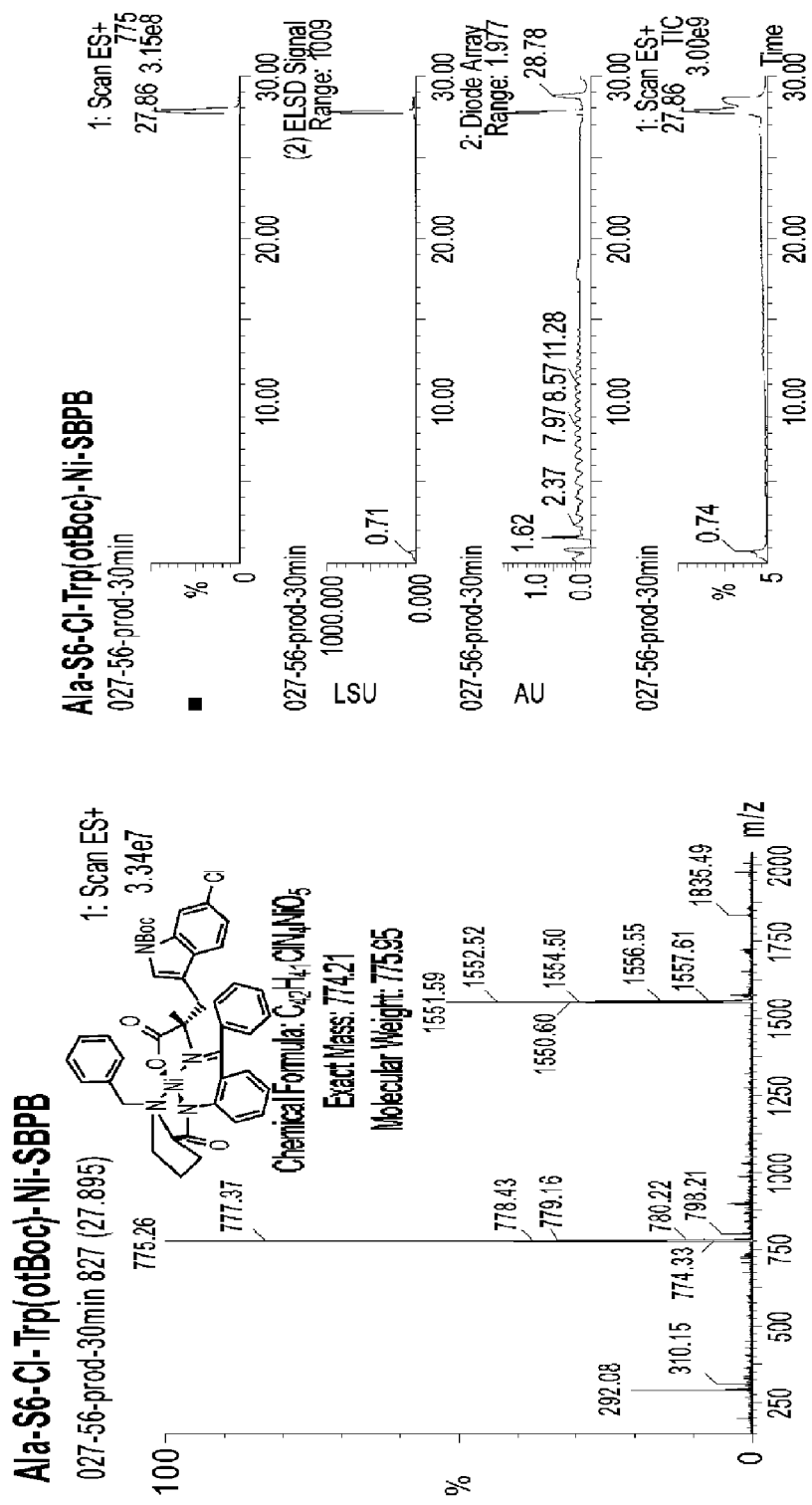
FIG. 2 shows an LC-MS trace of Me-6-Chloro-(Boc)Tryptophan-Ni—S—BPB.
Figure 3:
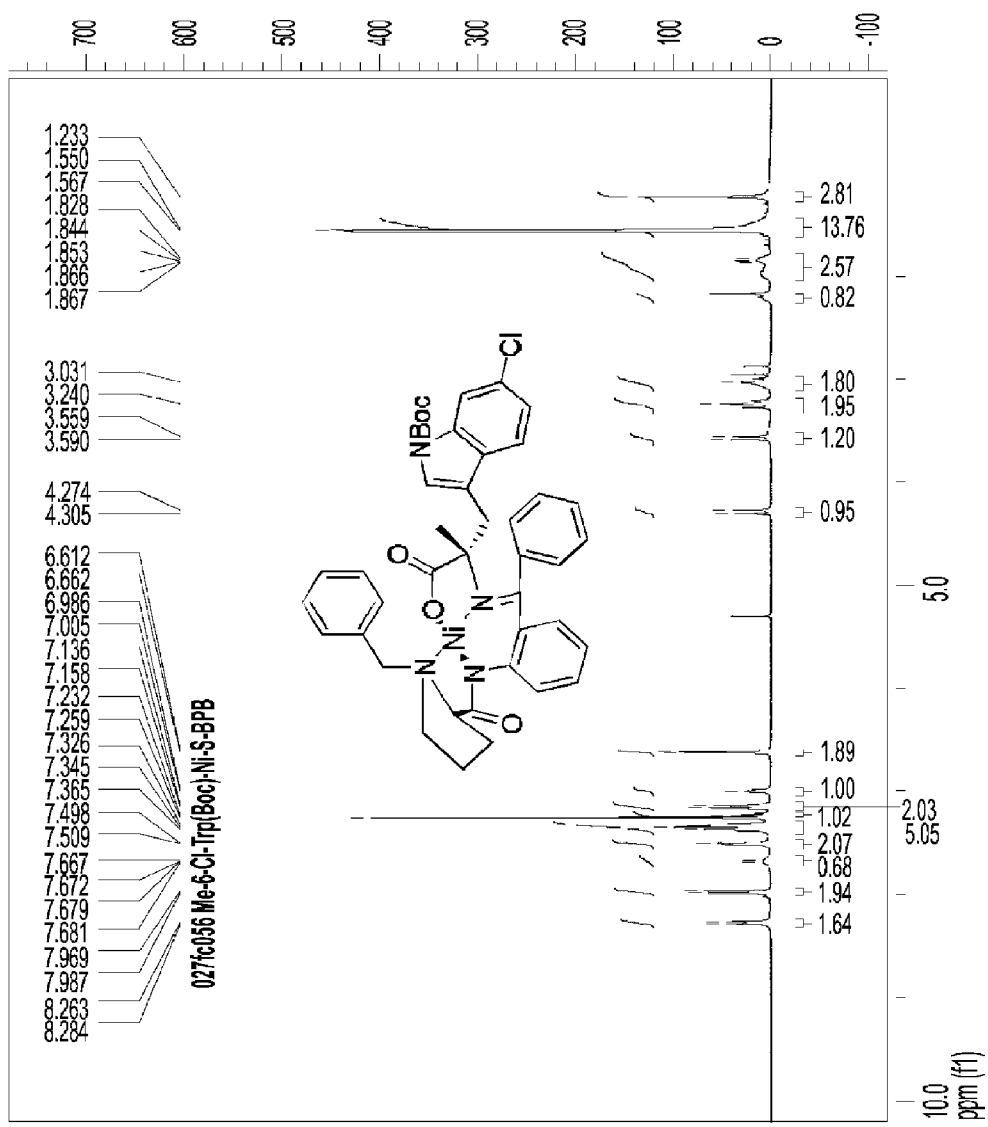
FIG. 3 shows a 1H-NMR spectrum of Me-6-Chloro-(Boc)Tryptophan-Ni—S—BPB.
Figure 4:
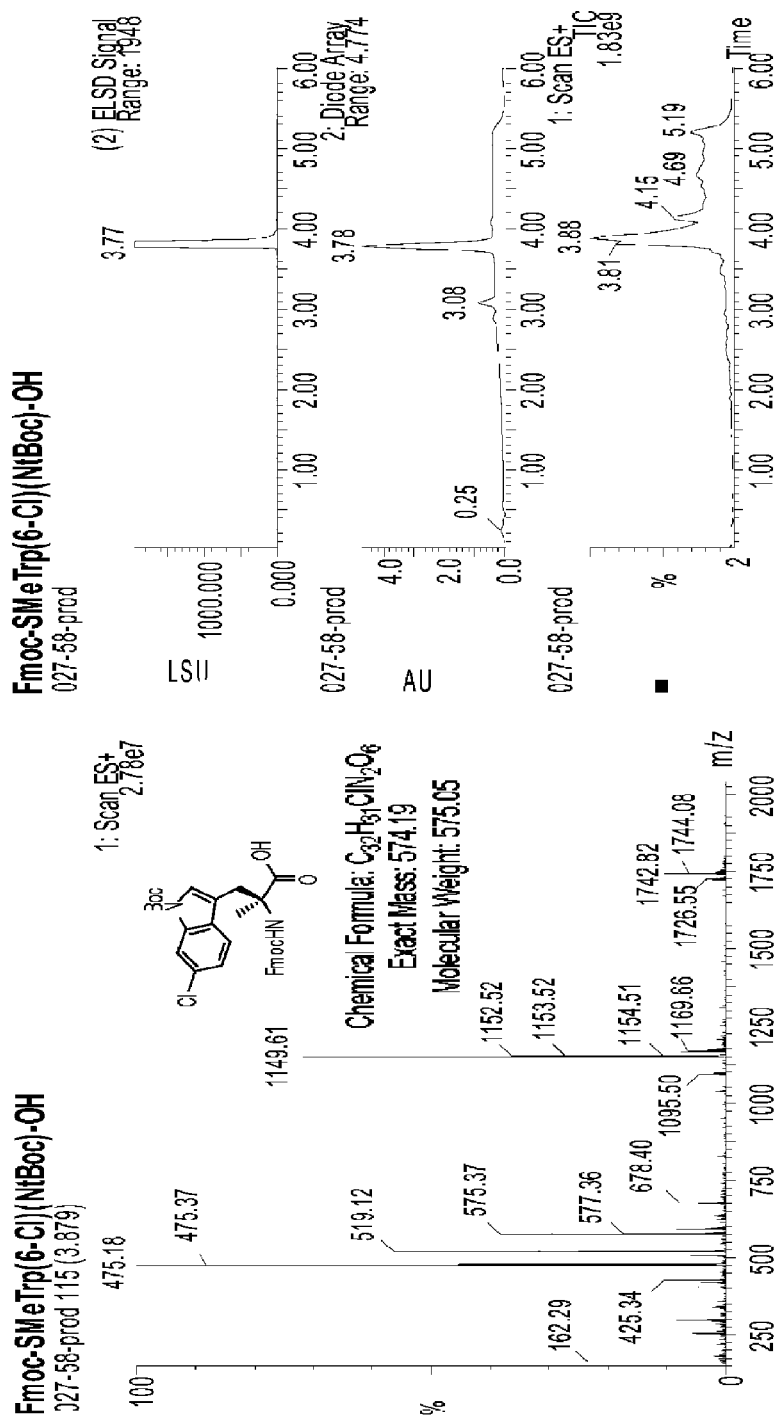
FIG. 4 shows an LC-MS trace of Fmoc-Me-6-Chloro-(Boc)Tryptophan.
Figure 5:
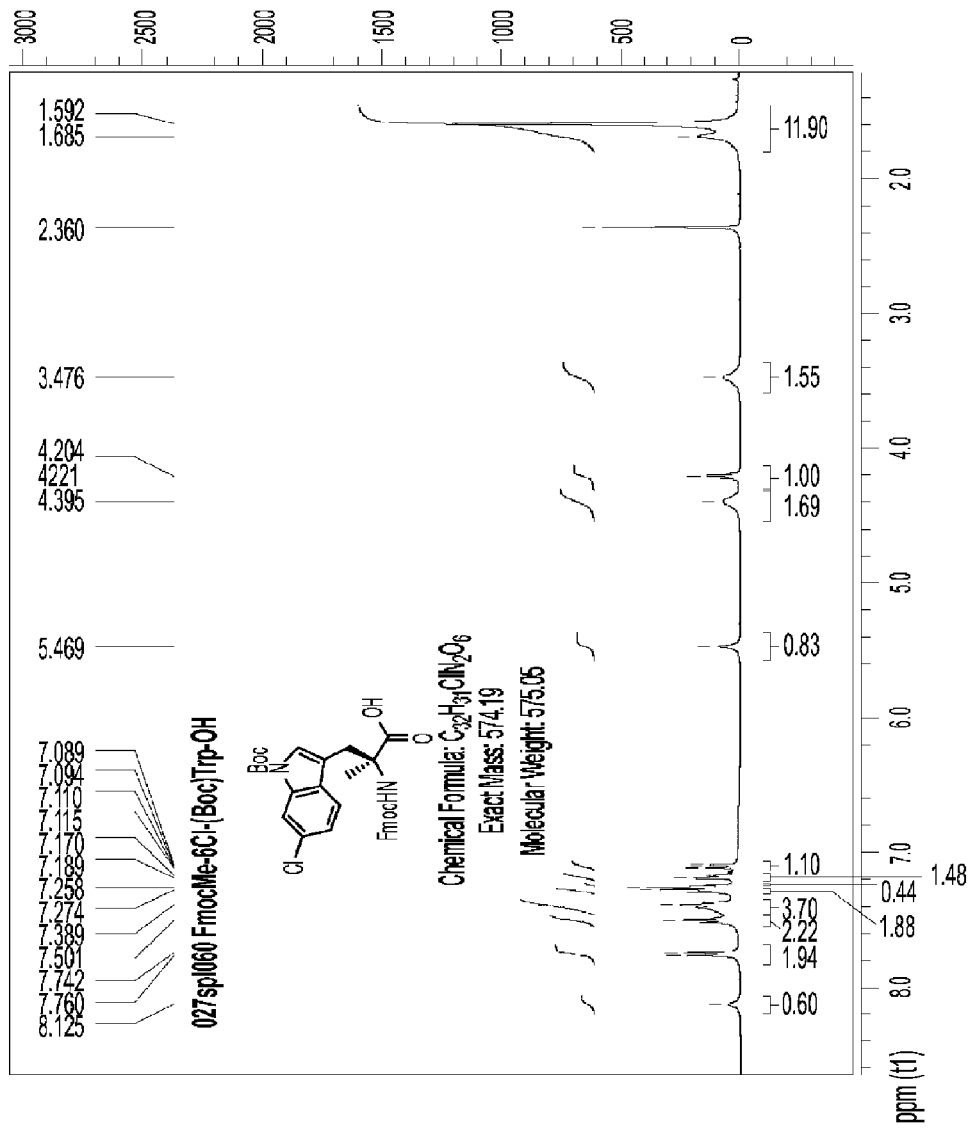
FIG. 5 shows a 1H-NMR spectrum of Fmoc-Me-6-Chloro-(Boc)Tryptophan.
Figure 8A:
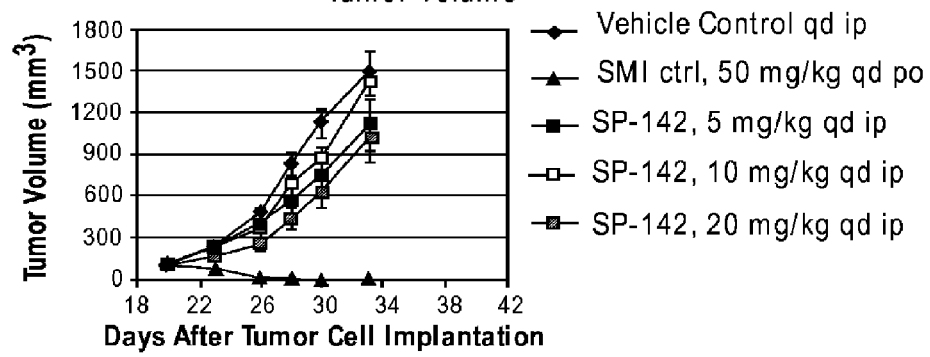
FIGS. 8A-B provide data from a variety of macrocycles.
Figure 8B:
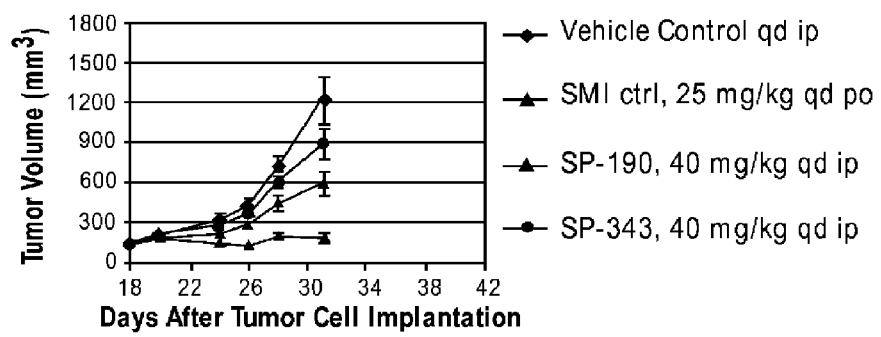

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analog) and a second naturally-occurring or non-naturally-occurring amino acid residue (or analog) within the same molecule. Peptidomimetic macrocycle include embodiments where the macrocycle-forming linker connects the α carbon of the first amino acid residue (or analog) to the α carbon of the second amino acid residue (or analog). The peptidomimetic macrocycles optionally include one or more non-peptide bonds between one or more amino acid residues and/or amino acid analog residues, and optionally include one or more non-naturally-occurring amino acid residues or amino acid analog residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

As used herein, the term "stability" refers to the maintenance of a defined secondary structure in solution by a peptidomimetic macrocycle of the invention as measured by circular dichroism, NMR or another biophysical measure, or resistance to proteolytic degradation in vitro or in vivo. Non-limiting examples of secondary structures contemplated in this invention are α-helices, β-turns, and β-pleated sheets.

As used herein, the term "helical stability" refers to the maintenance of α helical structure by a peptidomimetic macrocycle of the invention as measured by circular dichroism or NMR. For example, in some embodiments, the peptidomimetic macrocycles of the invention exhibit at least a 1.25, 1.5, 1.75 or 2-fold increase in α-helicity as determined by circular dichroism compared to a corresponding uncrosslinked macrocycle.

The term "α-amino acid" or simply "amino acid" refers to a molecule containing both an amino group and a carboxyl group bound to a carbon which is designated the α-carbon. Suitable amino acids include, without limitation, both the D- and L-isomers of the naturally-occurring amino acids, as well as non-naturally occurring amino acids prepared by organic synthesis or other metabolic routes. Unless the context specifically indicates otherwise, the term amino acid, as used herein, is intended to include amino acid analogs.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The term "amino acid analog" or "non-natural amino acid" refers to a molecule which is structurally similar to an amino acid and which can be substituted for an amino acid in the formation of a peptidomimetic macrocycle. Amino acid analogs include, without limitation, compounds which are structurally identical to an amino acid, as defined herein, except for the inclusion of one or more additional methylene groups between the amino and carboxyl group (e.g., α-amino β-carboxy acids), or for the substitution of the amino or carboxy group by a similarly reactive group (e.g., substitution of the primary amine with a secondary or tertiary amine, or substitution of the carboxy group with an ester). Non-natural amino acids include structures according to the following:

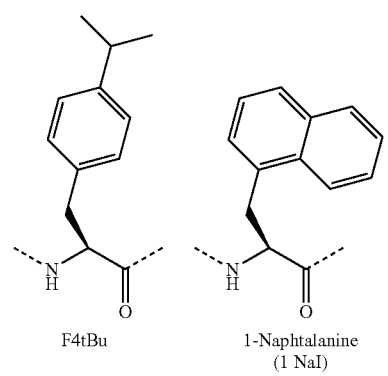

F4tBu      1-Naphtalanine (1 NaI)

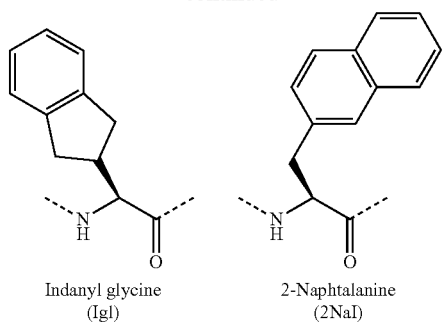
Indanyl glycine (Igl)
2-Naphtalanine (2NaI)
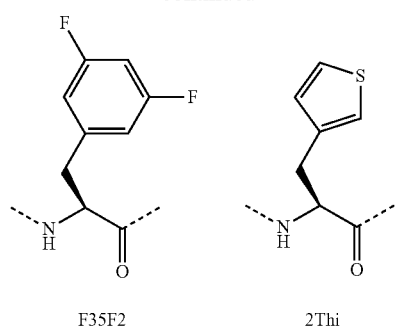
F35F2
2Thi
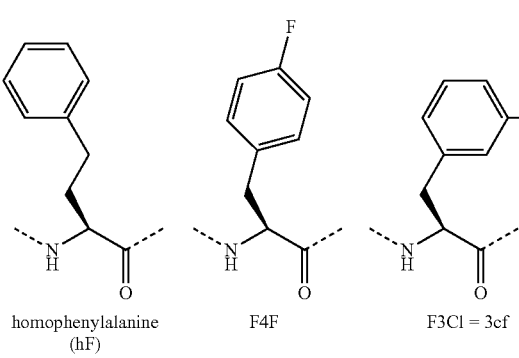
homophenylalanine (hF)
F4F
F3Cl = 3cf
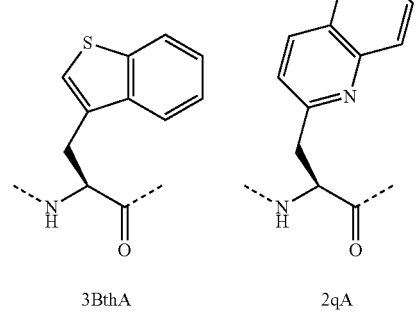
3BthA
2qA
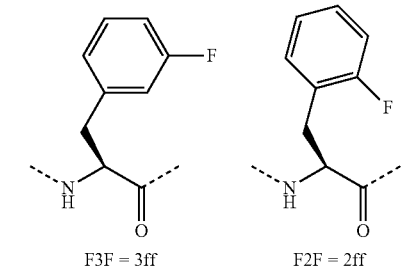
F3F = 3ff
F2F = 2ff
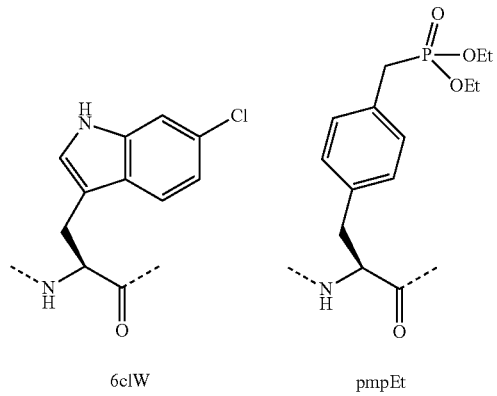
6clW
pmpEt
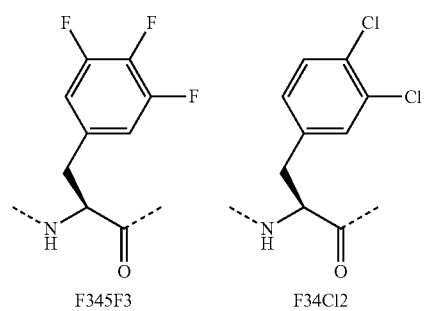
F345F3
F34Cl2
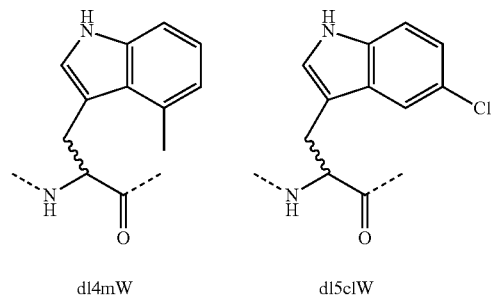
dl4mW
dl5clW
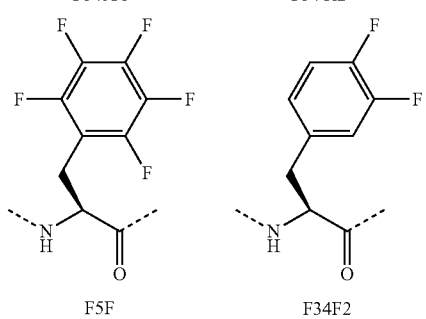
F5F
F34F2
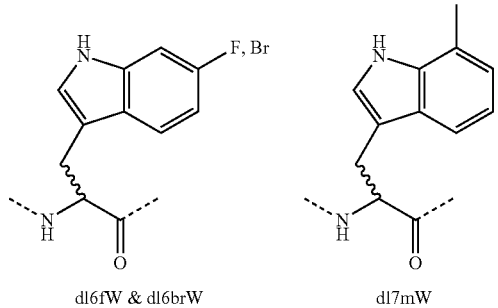
dl6fW & dl6brW
dl7mW

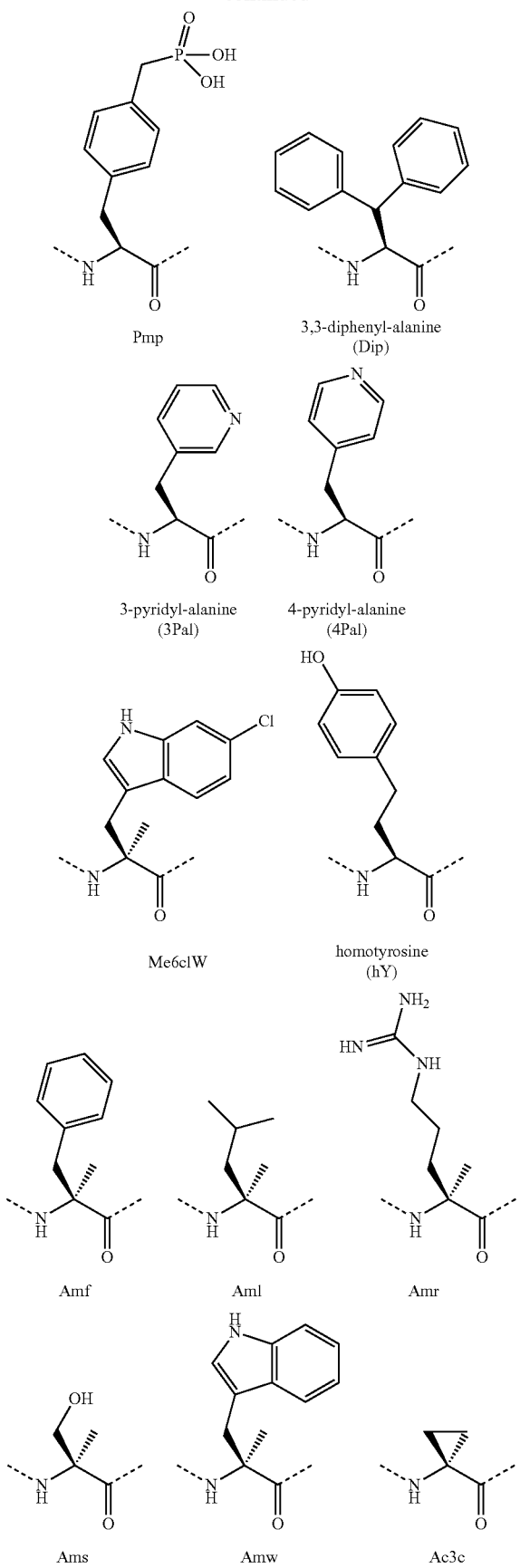
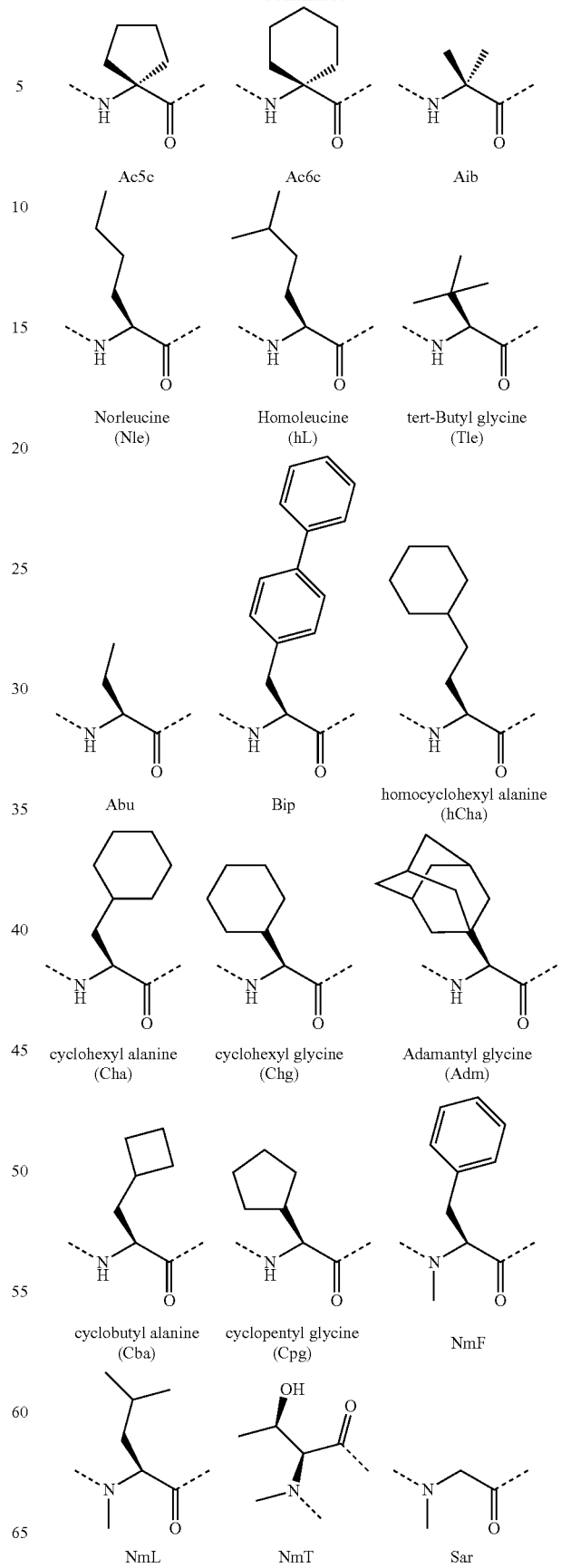

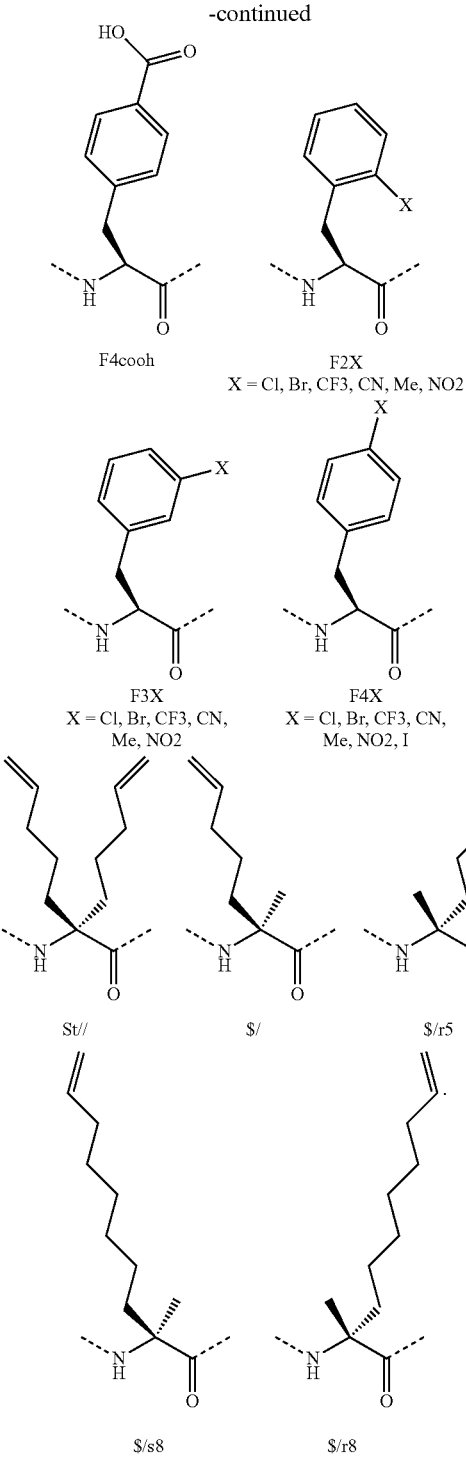

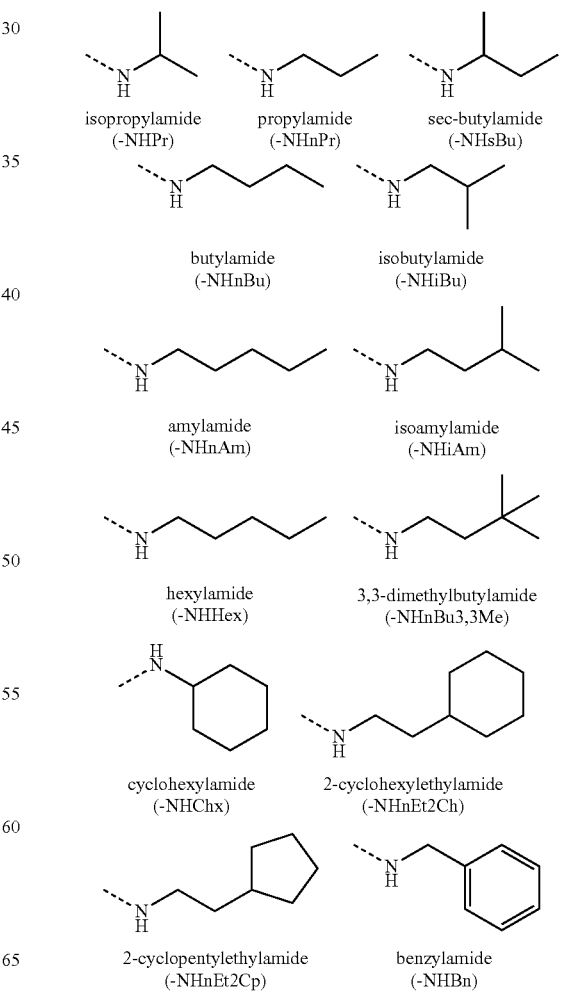

A "non-essential" amino acid residue is a residue that can be altered from the wild-type sequence of a polypeptide without abolishing or substantially altering its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, for example, is preferably replaced with another amino acid residue from the same side chain family. Other examples of acceptable substitutions are substitutions based on isosteric considerations (e.g. norleucine for methionine) or other properties (e.g. 2-thienylalanine for phenylalanine).

The term "capping group" refers to the chemical moiety occurring at either the carboxy or amino terminus of the polypeptide chain of the subject peptidomimetic macrocycle. The capping group of a carboxy terminus includes an unmodified carboxylic acid (ie —COOH) or a carboxylic acid with a substituent. For example, the carboxy terminus may be substituted with an amino group to yield a carboxamide at the C-terminus. Various substituents include but are not limited to primary and secondary amines, including pegylated secondary amines. Representative secondary amine capping groups for the C-terminus include:

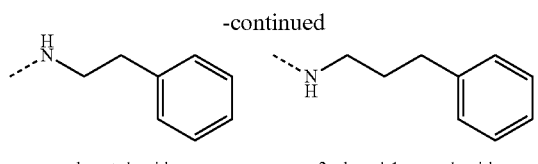

phenetylamide (-NHPe)     3-phenyl-1-propylamide (-NHnPr3Ph)

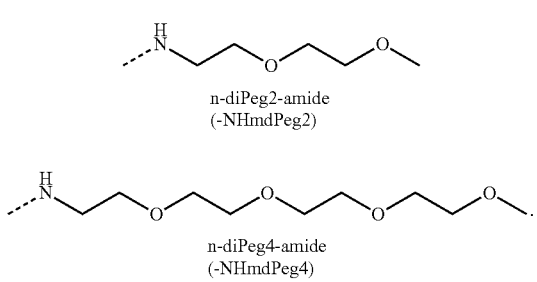

n-diPeg2-amide (-NHmdPeg2)

n-diPeg4-amide (-NHmdPeg4)

The capping group of an amino terminus includes an unmodified amine (ie —NH$_2$) or an amine with a substituent. For example, the amino terminus may be substituted with an acyl group to yield a carboxamide at the N-terminus. Various substituents include but are not limited to substituted acyl groups, including $C_1$-$C_6$ carbonyls, $C_7$-$C_{30}$ carbonyls, and pegylated carbamates. Representative capping groups for the N-terminus include:

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⫽" when used as part of a molecular structure refers to a single bond or a trans or cis double bond.

The term "amino acid side chain" refers to a moiety attached to the α-carbon in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,☐α di-substituted amino acid).

The term "α,☐α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a

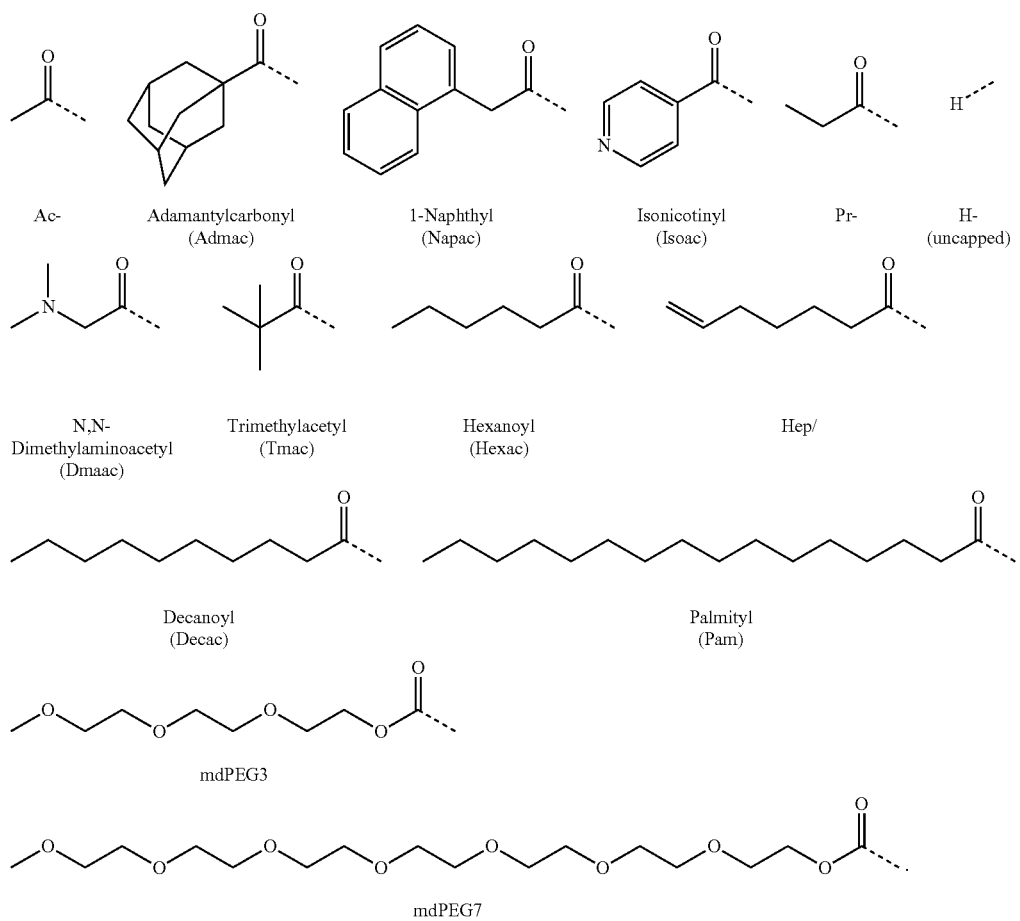

covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "macrocyclization reagent" or "macrocycle-forming reagent" as used herein refers to any reagent which may be used to prepare a peptidomimetic macrocycle of the invention by mediating the reaction between two reactive groups. Reactive groups may be, for example, an azide and alkyne, in which case macrocyclization reagents include, without limitation, Cu reagents such as reagents which provide a reactive Cu(I) species, such as CuBr, CuI or CuOTf, as well as Cu(II) salts such as $Cu(CO_2CH_3)_2$, $CuSO_4$, and $CuCl_2$ that can be converted in situ to an active Cu(I) reagent by the addition of a reducing agent such as ascorbic acid or sodium ascorbate. Macrocyclization reagents may additionally include, for example, Ru reagents known in the art such as $Cp*RuCl(PPh_3)_2$, $[Cp*RuCl]_4$ or other Ru reagents which may provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. Additional catalysts are disclosed in Grubbs et al., "Ring Closing Metathesis and Related Processes in Organic Synthesis" Acc. Chem. Res. 1995, 28, 446-452, and U.S. Pat. No. 5,811,515. In yet other cases, the reactive groups are thiol groups. In such embodiments, the macrocyclization reagent is, for example, a linker functionalized with two thiol-reactive groups such as halogen groups.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkyl" or the term "aralkyl" refers to alkyl substituted with an aryl. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH2-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl, "Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH$_3$, and —CH$_2$—CH$_2$—NH—C(O)—CH=CH$_2$.

"Alkanol" refers to a $C_1$-$C_5$ alkyl group, as defined above, wherein one of the $C_1$-$C_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a $C_1$-$C_5$ alkyl group, as defined above, wherein one of the $C_1$-$C_5$ alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl.

The term "heteroarylalkoxy" refers to an alkoxy substituted with heteroaryl.

The term "heteroarylalkyl" or the term "heteroaralkyl" refers to an alkyl substituted with a heteroaryl.

The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds of this invention contain one or more asymmetric centers and thus occur as racemates and racemic mixtures, single enantiomers, individual diastereomers and diastereomeric mixtures. All such isomeric forms of these compounds are included in the present invention unless expressly provided otherwise. In some embodiments, the compounds of this invention are also represented in multiple tautomeric forms, in such instances, the invention includes all tautomeric forms of the compounds described herein (e.g., if alkylation of a ring system results in alkylation at multiple sites, the invention includes all such reaction products). All such isomeric forms of such compounds are included in the present invention unless expressly provided otherwise. All crystal forms of the compounds described herein are included in the present invention unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the invention may be practiced with the variable equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The term "on average" represents the mean value derived from performing at least three independent replicates for each data point.

The term "biological activity" encompasses structural and functional properties of a macrocycle of the invention. Biological activity is, for example, structural stability, alpha-helicity, affinity for a target, resistance to proteolytic degradation, cell penetrability, intracellular stability, in vivo stability, or any combination thereof.

The details of one or more particular embodiments of the invention are set forth in the accompanying drawings and the description below. Other features, objects, and advantages of the invention will be apparent from the description and drawings, and from the claims.

In some embodiments, the peptide sequences are derived from the p53 protein.

A non-limiting exemplary list of suitable p53 peptides for use in the present invention is given below.

TABLE 1

(SEQ ID NOS 1-18, respectively, in order of appearance)

| Sequence (bold = critical residue; X = cross-linked amino acid) | | | | | | | | | | | | | | | | | | | Design Notes |
|---|---|---|---|---|---|---|---|---|---|---|---|---|---|---|---|---|---|---|---|
| Ac— | | Gln | Ser | Gln | Gln | Thr | Phe | Ser | Asn | Leu | Trp | Arg | Leu | Leu | Pro | Gln | Asn | —NH2 | linear |
| Ac— | X | Gln | Ser | Gln | X | Thr | Phe | Ser | Asn | Leu | Trp | Arg | Leu | Leu | Pro | Gln | Asn | —NH2 | i --> i + 4 x-link #1 |
| Ac— | | X | Ser | Gln | Gln | X | Phe | Ser | Asn | Leu | Trp | Arg | Leu | Leu | Pro | Gln | Asn | —NH2 | i --> i + 4 x-link #2 |
| Ac— | | Gln | Ser | X | Gln | Thr | Phe | X | Asn | Leu | Trp | Arg | Leu | Leu | Pro | Gln | Asn | —NH2 | i --> i + 4 x-link #3 |
| Ac— | | Gln | Ser | Gln | X | Thr | Phe | Ser | X | Leu | Trp | Arg | Leu | Leu | Pro | Gln | Asn | —NH2 | i --> i + 4 x-link #4 |
| Ac— | | Gln | Ser | Gln | Gln | X | Phe | Ser | Asn | X | Trp | Arg | Leu | Leu | Pro | Gln | Asn | —NH2 | i --> i + 4 x-link #5 |
| Ac— | | Gln | Ser | Gln | Gln | Thr | Phe | X | Asn | Leu | Trp | X | Leu | Leu | Pro | Gln | Asn | —NH2 | i --> i + 4 x-link #6 |
| Ac— | | Gln | Ser | Gln | Gln | Thr | Phe | Ser | X | Leu | Trp | Arg | X | Leu | Pro | Gln | Asn | —NH2 | i --> i + 4 x-link #7 |
| Ac— | | Gln | Ser | Gln | Gln | Thr | Phe | Ser | Asn | Leu | Trp | X | Leu | Leu | Pro | X | Asn | —NH2 | i --> i + 4 x-link #8 |

TABLE 1-continued (SEQ ID NOS 1-18, respectively, in order of appearance)

| Sequence (bold = critical residue; X = cross-linked amino acid) | | | | | | | | | | | | | | | | | Design Notes |
|---|---|---|---|---|---|---|---|---|---|---|---|---|---|---|---|---|---|
| Ac— | | Gln | Ser | Gln | Gln | Thr | Phe | Ser | Asn | Leu | Trp | Arg | X | Leu | Pro | Gln | X | —NH2 i --> i + 4 x-link #9 |
| Ac— | X | Gln | Ser | Gln | Gln | Thr | Phe | X | Asn | Leu | Trp | Arg | Leu | Leu | Pro | Gln | Asn | —NH2 i --> i + 7 x-link #1 |
| Ac— | | X | Ser | Gln | Gln | Thr | Phe | Ser | X | Leu | Trp | Arg | Leu | Leu | Pro | Gln | Asn | —NH2 i --> i + 7 x-link #2 |
| Ac— | | Gln | X | Gln | Gln | Thr | Phe | Ser | Asn | X | Trp | Arg | Leu | Leu | Pro | Gln | Asn | —NH2 i --> i + 7 x-link #3 |
| Ac— | | Gln | Ser | Gln | X | Thr | Phe | Ser | Asn | Leu | Trp | X | Leu | Leu | Pro | Gln | Asn | —NH2 i --> i + 7 x-link #4 |
| Ac— | | Gln | Ser | Gln | Gln | X | Phe | Ser | Asn | Leu | Trp | Arg | X | Leu | Pro | Gln | Asn | —NH2 i --> i + 7 x-link #5 |
| Ac— | | Gln | Ser | Gln | Gln | Thr | Phe | X | Asn | Leu | Trp | Arg | Leu | Leu | X | Gln | Asn | —NH2 i --> i + 7 x-link #6 |
| Ac— | | Gln | Ser | Gln | Gln | Thr | Phe | Ser | X | Leu | Trp | Arg | Leu | Leu | Pro | X | Asn | —NH2 i --> i + 7 x-link #7 |
| Ac— | | Gln | Ser | Gln | Gln | Thr | Phe | Ser | Asn | X | Trp | Arg | Leu | Leu | Pro | Gln | X | —NH2 i --> i + 7 x-link #8 |

TABLE 2

(SEQ ID NOS 19-31, respectively, in order of appearance)

| Sequence (bold = critical residue; X = cross-linked amino acid) | | | | | | | | | | | | | | Design Notes |
|---|---|---|---|---|---|---|---|---|---|---|---|---|---|---|
| Ac— | | Leu | Thr | Phe | Glu | His | Tyr | Trp | Ala | Gln | Leu | Thr | Ser | | —NH2 linear |
| Ac— | X | Leu | Thr | Phe | X | His | Tyr | Trp | Ala | Gln | Leu | Thr | Ser | | —NH2 i --> i + 4 x-link #1 |
| Ac— | | X | Thr | Phe | Glu | X | Tyr | Trp | Ala | Gln | Leu | Thr | Ser | | —NH2 i --> i + 4 x-link #2 |
| Ac— | | Leu | X | Phe | Glu | His | X | Trp | Ala | Gln | Leu | Thr | Ser | | —NH2 i --> i + 4 x-link #3 |
| Ac— | | Leu | Thr | Phe | X | His | Tyr | Trp | X | Gln | Leu | Thr | Ser | | —NH2 i --> i + 4 x-link #4 |
| Ac— | | Leu | Thr | Phe | Glu | X | Tyr | Trp | Ala | X | Leu | Thr | Ser | | —NH2 i --> i + 4 x-link #5 |
| Ac— | | Leu | Thr | Phe | Glu | His | Tyr | Trp | X | Gln | Leu | Thr | X | | —NH2 i --> i + 4 x-link #6 |
| Ac— | | Leu | Thr | Phe | Glu | His | Tyr | Trp | Ala | X | Leu | Thr | Ser | X | —NH2 i --> i + 4 x-link #7 |
| Ac— | | X | Thr | Phe | Glu | His | Tyr | Trp | X | Gln | Leu | Thr | Ser | | —NH2 i --> i + 7 x-link #1 |
| Ac— | | Gln | X | Phe | Glu | His | Tyr | Trp | Ala | X | Leu | Thr | Ser | | —NH2 i --> i + 7 x-link #2 |
| Ac— | | Gln | Thr | Phe | X | His | Tyr | Trp | Ala | Gln | Leu | X | Ser | | —NH2 i --> i + 7 x-link #3 |
| Ac— | | Gln | Thr | Phe | Glu | X | Tyr | Trp | Ala | Gln | Leu | Thr | X | | —NH2 i --> i + 7 x-link #4 |
| Ac— | | Gln | Thr | Phe | Glu | His | X | Trp | Ala | Gln | Leu | Thr | Ser | X | —NH2 i --> i + 7 x-link #5 |

TABLE 3

(SEQ ID NOS 32-37, respectively, in order of appearance)

| Sequence (bold = critical residue; X = cross-linked amino acid) | | | | | | | | | Design Notes |
|---|---|---|---|---|---|---|---|---|---|
| Ac— | | Phe | Met | Aib/His/Asn | Tyr | 6-ClTrp | Glu | Ac3c/Gln/Leu | Leu | —NH2 linear |
| Ac— | X | Phe | Met | Aib/His/Asn | X | 6-ClTrp | Glu | Ac3c/Gln/Leu | Leu | —NH2 i --> i + 4 x-link #1 |
| Ac— | | Phe | X | Aib/His/Asn | Tyr | 6-ClTrp | X | Ac3c/Gln/Leu | Leu | —NH2 i --> i + 4 x-link #2 |
| Ac— | | Phe | Met | X | Tyr | 6-ClTrp | Glu | X | Leu | —NH2 i --> i + 4 x-link #3 |
| Ac— | X | Phe | Met | Aib/His/Asn | Tyr | 6-ClTrp | Glu | X | Leu | —NH2 i --> i + 7 x-link #1 |

TABLE 3-continued (SEQ ID NOS 32-37, respectively, in order of appearance)

| Sequence (bold = critical residue; X = cross-linked amino acid) | | | | | | | | | Design Notes |
|---|---|---|---|---|---|---|---|---|---|
| Ac— | Phe | X | Aib/His/Asn | Tyr | 6-ClTrp | Glu | Ac3c/Gln/Leu | Leu X | —NH2 i--> i + 7 x-link #2 |

In Table 3 and elsewhere, "Aib" represents a 2-aminoisobutyric acid residue, while "Ac3c" represents a aminocyclopropane carboxylic acid residue.

Peptidomimetic Macrocycles

In some embodiments, a peptidomimetic macrocycle of the invention has the Formula (I):

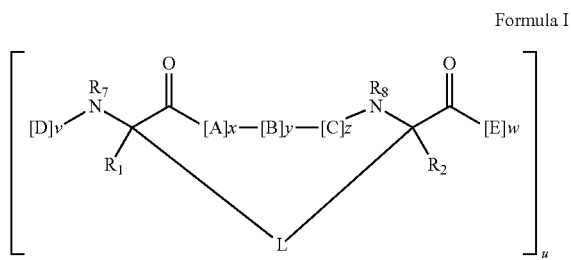

Formula I wherein:

each A, C, D, and E is independently a natural or non-natural amino acid, and the terminal D and E independently optionally include a capping group;

B is a natural or non-natural amino acid, amino acid analog,

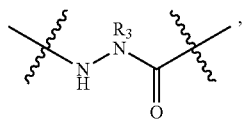

$[-NH-L_3-CO-]$, $[-NH-L_3-SO_2-]$, or $[-NH-L_3-]$;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

L is a macrocycle-forming linker of the formula $-L_1-L_2-$;

$L_1$ and $L_2$ are independently alkylene, alkenylene, alkynylene, heteroalkylene, cycloalkylene, heterocycloalkylene, cycloarylene, heterocycloarylene, or $[-R_4-K-R_4-]_n$, each being optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v and w are independently integers from 1-1000;

u is an integer from 1-10;

x, y and z are independently integers from 0-10; and n is an integer from 1-5.

In one embodiment, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments of the invention, x+y+z is at least 3. In other embodiments of the invention, x+y+z is 1, 2, 3, 4, 5, 6, 7, 8, 9 or 10. Each occurrence of A, B, C, D or E in a macrocycle or macrocycle precursor of the invention is independently selected. For example, a sequence represented by the formula $[A]_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound of the invention may encompass peptidomimetic macrocycles which are the same or different. For example, a compound of the invention may comprise peptidomimetic macrocycles comprising different linker lengths or chemical compositions.

In some embodiments, the peptidomimetic macrocycle of the invention comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

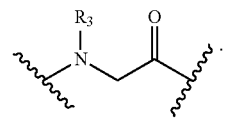

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In one embodiment, the peptidomimetic macrocycle of Formula (I) is:

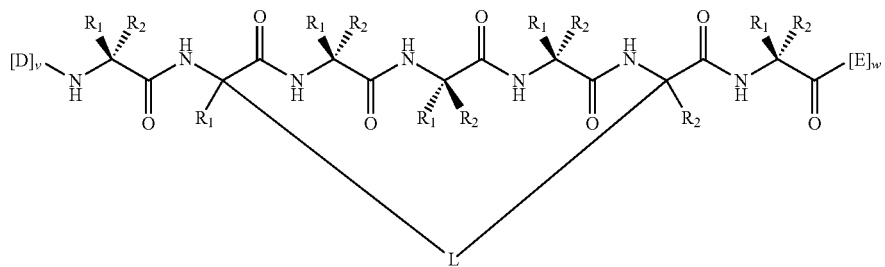

wherein each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle of Formula (I) is:

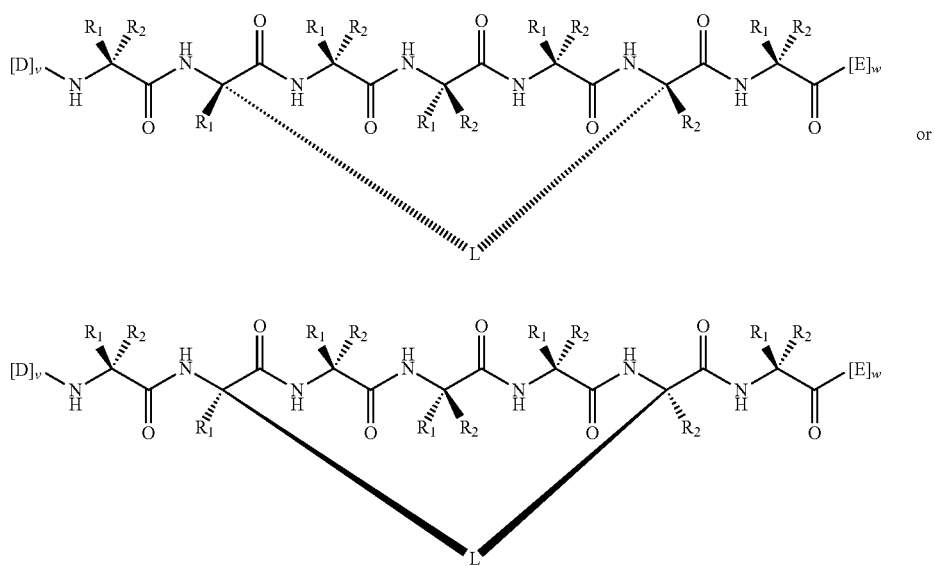

or

In other embodiments, the peptidomimetic macrocycle of Formula (I) is a compound of any of the formulas shown below:

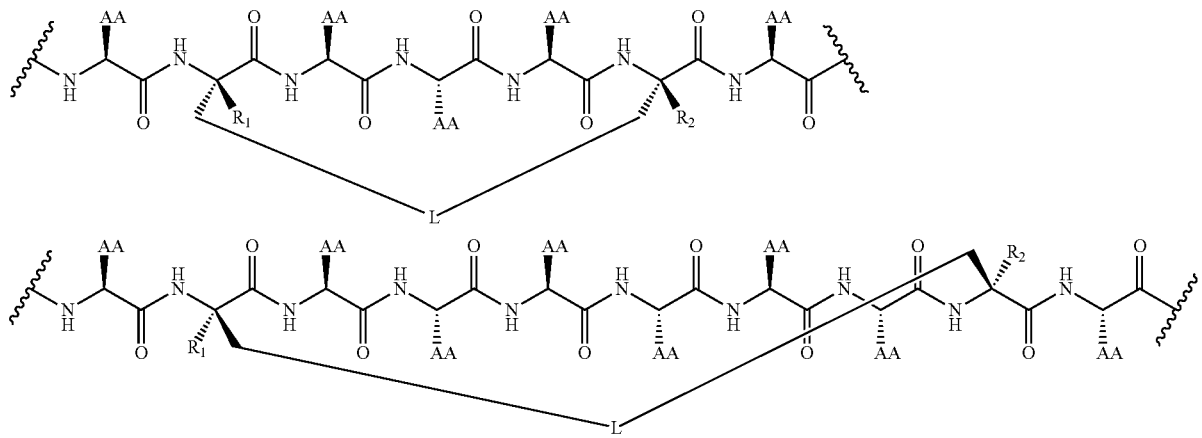

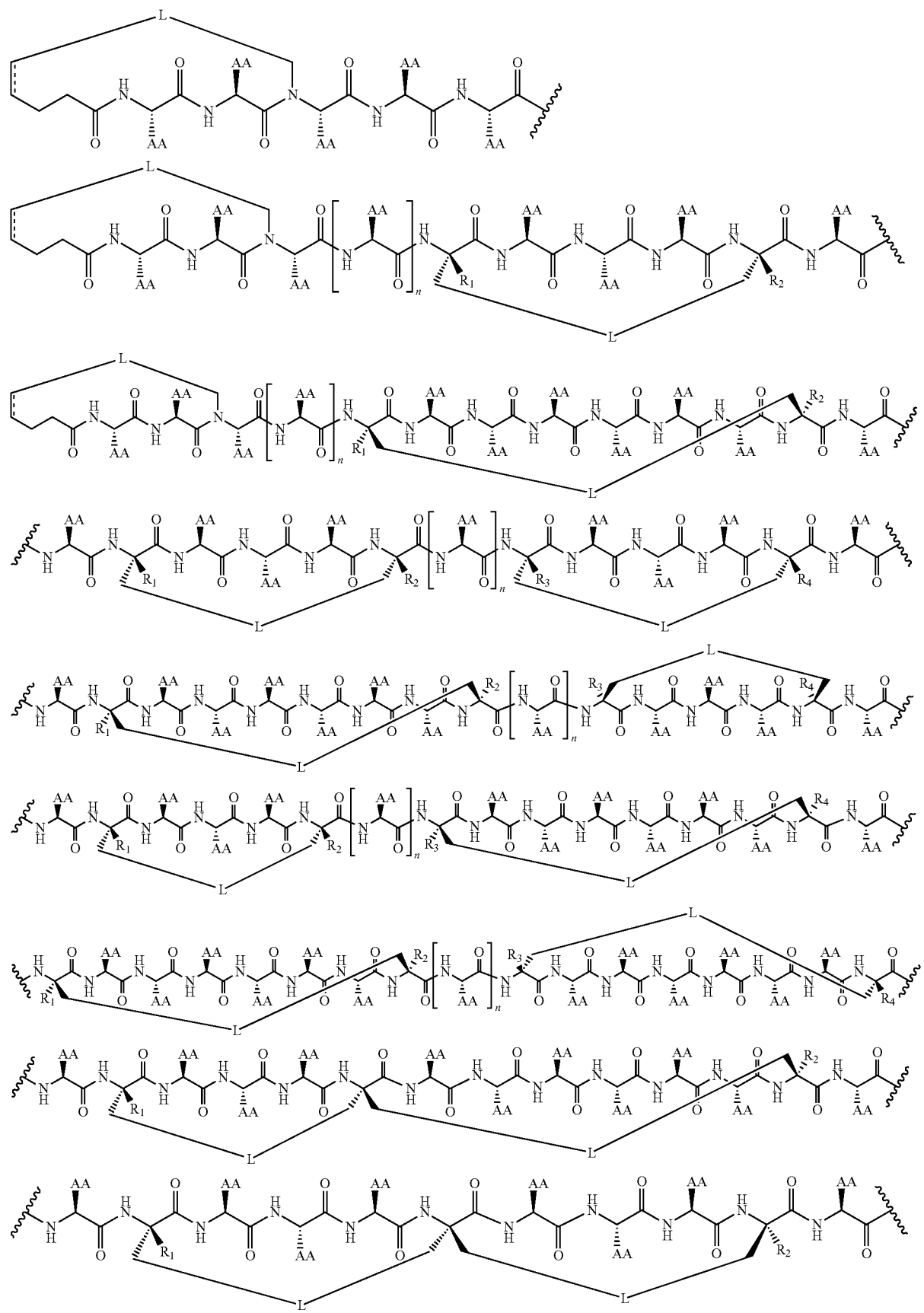

-continued

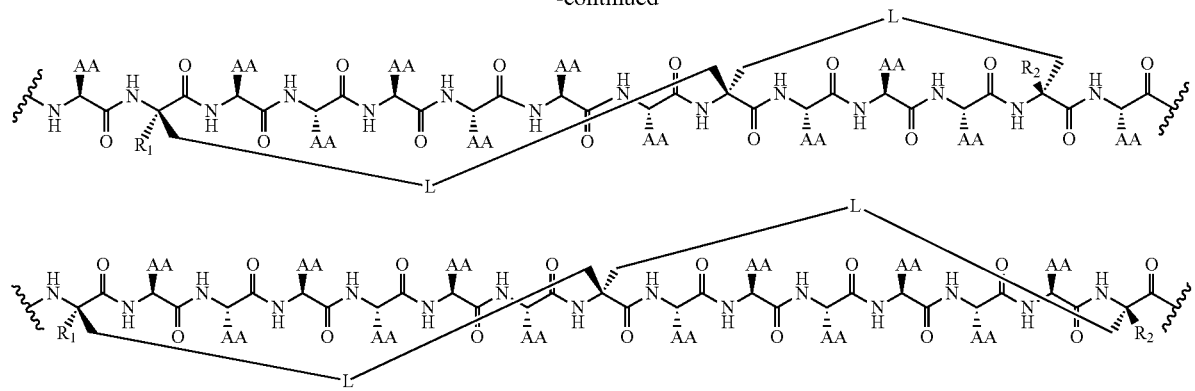

wherein "AA" represents any natural or non-natural amino acid side chain and "⸹" is $[D]_v$, $[E]_w$ as defined above, and n is an integer between 0 and 20, 50, 100, 200, 300, 400 or 500. In some embodiments, n is 0. In other embodiments, n is less than 50.

Exemplary embodiments of the macrocycle-forming linker L are shown below.

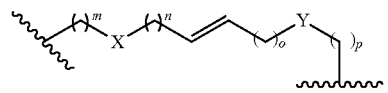

where X, Y = -CH$_2$-, O, S, or NH
m, n, p = 0-10

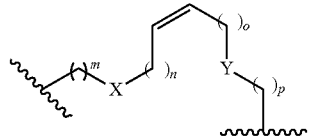

where X, Y = -CH$_2$-, O, S, or NH
m, n, p = 0-10

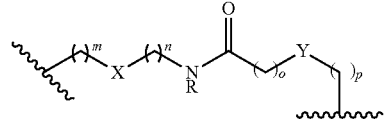

where X, Y = -CH$_2$-, O, S, or NH
m, n, p = 0-10
R = H, alkyl, other substituent

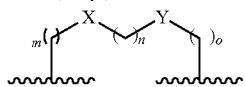

where X, Y = -CH$_2$-, O, S, or NH
m, n, p = 0-10

In other embodiments, D and/or E in the compound of Formula I are further modified in order to facilitate cellular uptake. In some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration.

In other embodiments, at least one of [D] and [E] in the compound of Formula I represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers. In an embodiment, u is 2.

In the peptidomimetic macrocycles of the invention, any of the macrocycle-forming linkers described herein may be used in any combination with any of the sequences shown in Tables 1-4 and also with any of the R— substituents indicated herein.

In some embodiments, the peptidomimetic macrocycle comprises at least one α-helix motif. For example, A, B and/or C in the compound of Formula I include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

In other embodiments, the invention provides peptidomimetic macrocycles of Formula (IV) or (IVa):

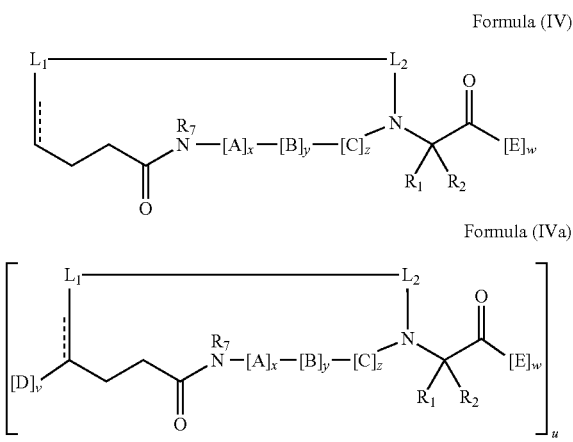

wherein:
each A, C, D, and E is independently a natural or non-natural amino acid, and the terminal D and E independently optionally include a capping group;

B is a natural or non-natural amino acid, amino acid analog,

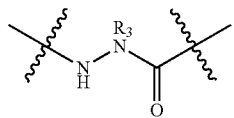

[—NH-$L_3$-CO—], [—NH-$L_3$-$SO_2$—], or [—NH-$L_3$-];

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-, or part of a cyclic structure with an E residue;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

L is a macrocycle-forming linker of the formula -$L_1$-$L_2$-;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$;

v and w are independently integers from 1-1000;

u is an integer from 1-10;

x, y and z are independently integers from 0-10; and n is an integer from 1-5.

In one example, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments of the invention, x+y+z is at least 1. In other embodiments of the invention, x+y+z is at least 2. In other embodiments of the invention, x+y+z is 1, 2, 3, 4, 5, 6, 7, 8, 9 or 10. Each occurrence of A, B, C, D or E in a macrocycle or macrocycle precursor of the invention is independently selected. For example, a sequence represented by the formula [A]$_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges.

In some embodiments, the peptidomimetic macrocycle of the invention comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

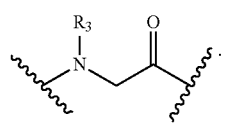

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Exemplary embodiments of the macrocycle-forming linker -L$_1$-L$_2$- are shown below.

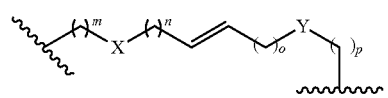

where X, Y = -CH$_2$-, O, S, or NH
m, n, p = 0-10

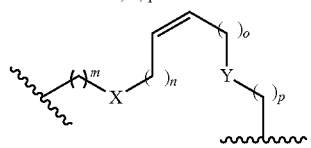

where X, Y = -CH$_2$-, O, S, or NH
m, n, p = 0-10

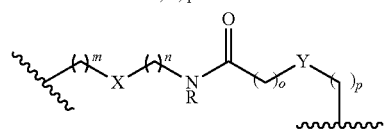

where X, Y = -CH$_2$-, O, S, or NH
m, n, p = 0-10
R = H, alkyl, other substituent

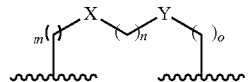

where X, Y = -CH$_2$-, O, S, or NH
m, n, p = 0-10

Preparation of Peptidomimetic Macrocycles

Peptidomimetic macrocycles of the invention may be prepared by any of a variety of methods known in the art. For example, any of the residues indicated by "X" in Tables 1, 2, 3, or 4 may be substituted with a residue capable of forming a crosslinker with a second residue in the same molecule or a precursor of such a residue.

Various methods to effect formation of peptidomimetic macrocycles are known in the art. For example, the preparation of peptidomimetic macrocycles of Formula I is described in Schafmeister et al., J. Am. Chem. Soc. 122: 5891-5892 (2000); Schafmeister & Verdin, J. Am. Chem. Soc. 122:5891 (2005); Walensky et al., Science 305:1466-1470 (2004); U.S. Pat. No. 7,192,713 and PCT application WO 2008/121767. The α,α-disubstituted amino acids and amino acid precursors disclosed in the cited references may be employed in synthesis of the peptidomimetic macrocycle precursor polypeptides. For example, the "S5-olefin amino acid" is (S)-α-(2'-pentenyl) alanine and the "R8 olefin amino acid" is (R)-α-(2'-octenyl) alanine. Following incorporation of such amino acids into precursor polypeptides, the terminal olefins are reacted with a metathesis catalyst, leading to the formation of the peptidomimetic macrocycle. In various embodiments, the following amino acids may be employed in the synthesis of the peptidomimetic macrocycle:

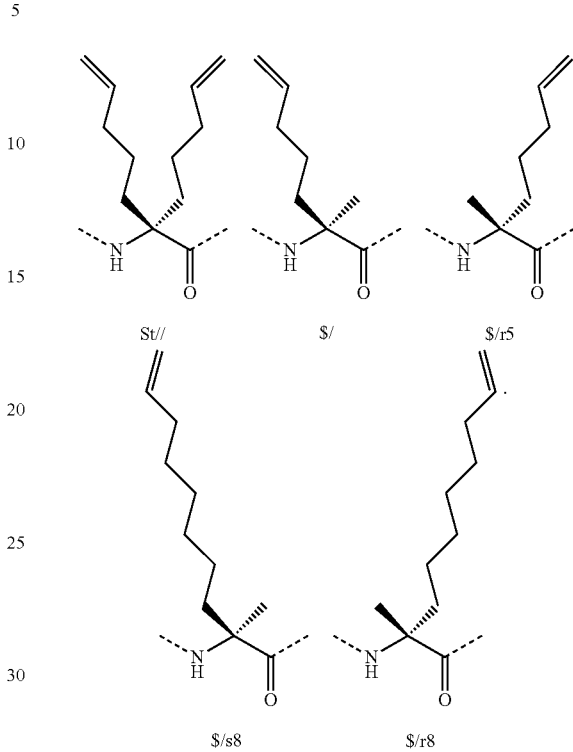

In other embodiments, the peptidomimetic macrocyles of the invention are of Formula IV or IVa. Methods for the preparation of such macrocycles are described, for example, in U.S. Pat. No. 7,202,332.

Additional methods of forming peptidomimetic macrocycles which are envisioned as suitable to perform the present invention include those disclosed by Mustapa, M. Firouz Mohd et al., J. Org. Chem (2003), 68, pp. 8193-8198; Yang, Bin et al. Bioorg Med. Chem. Lett. (2004), 14, pp. 1403-1406; U.S. Pat. No. 5,364,851; U.S. Pat. No. 5,446,128; U.S. Pat. No. 5,824,483; U.S. Pat. No. 6,713,280; and U.S. Pat. No. 7,202,332. In such embodiments, aminoacid precursors are used containing an additional substituent R— at the alpha position. Such aminoacids are incorporated into the macrocycle precursor at the desired positions, which may be at the positions where the crosslinker is substituted or, alternatively, elsewhere in the sequence of the macrocycle precursor. Cyclization of the precursor is then effected according to the indicated method.

Assays

The properties of the peptidomimetic macrocycles of the invention are assayed, for example, by using the methods described below. In some embodiments, a peptidomimetic macrocycle of the invention has improved biological properties relative to a corresponding polypeptide lacking the substituents described herein.

Assay to Determine α-Helicity.

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles of the invention will possess an alpha-helicity of greater than 50%. To assay the helicity of peptidomimetic macrocycles of the invention, the compounds are dissolved in an aqueous solution (e.g. 50 mM potassium phosphate solution at pH 7, or distilled $H_2O$, to concentrations of 25-50 µM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222 obs) by the reported value for a model helical decapeptide (Yang et al. (1986), *Methods Enzymol.* 130:208)).

Assay to Determine Melting Temperature (Tm).

A peptidomimetic macrocycle of the invention comprising a secondary structure such as an α-helix exhibits, for example, a higher melting temperature than a corresponding uncrosslinked polypeptide. Typically peptidomimetic macrocycles of the invention exhibit Tm of >60° C. representing a highly stable structure in aqueous solutions. To assay the effect of macrocycle formation on melting temperature, peptidomimetic macrocycles or unmodified peptides are dissolved in distilled $H_2O$ (e.g. at a final concentration of 50 µM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay.

The amide bond of the peptide backbone is susceptible to hydrolysis by proteases, thereby rendering peptidic compounds vulnerable to rapid degradation in vivo. Peptide helix formation, however, typically buries the amide backbone and therefore may shield it from proteolytic cleavage. The peptidomimetic macrocycles of the present invention may be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln [S] versus time (k=−1×slope).

Ex Vivo Stability Assay.

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays may be used. For example, a peptidomimetic macrocycle and a corresponding uncrosslinked polypeptide (2 mcg) are incubated with fresh mouse, rat and/or human serum (2 mL) at 37° C. for 0, 1, 2, 4, 8, and 24 hours. To determine the level of intact compound, the following procedure may be used: The samples are extracted by transferring 100 µl of sera to 2 ml centrifuge tubes followed by the addition of 10 µL of 50% formic acid and 500 µL acetonitrile and centrifugation at 14,000 RPM for 10 min at 4±2° C. The supernatants are then transferred to fresh 2 ml tubes and evaporated on Turbovap under $N_2$<10 psi, 37° C. The samples are reconstituted in 100 µL of 50:50 acetonitrile:water and submitted to LC-MS/MS analysis.

In Vitro Binding Assays.

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values may be determined by nonlinear regression analysis using, for example, Graphpad Prism software (GraphPad Software, Inc., San Diego, Calif.). A peptidomimetic macrocycle of the invention shows, in some instances, similar or lower Kd than a corresponding uncrosslinked polypeptide.

In Vitro Displacement Assays to Characterize Antagonists of Peptide-Protein Interactions.

To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values may be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay.

Assay for Protein-Ligand Binding by Affinity Selection-Mass Spectrometry

To assess the binding and affinity of test compounds for proteins, an affinity-selection mass spectrometry assay is used, for example. Protein-ligand binding experiments are conducted according to the following representative procedure outlined for a system-wide control experiment using 1 µM peptidomimetic macrocycle plus 5 µM hMDM2. A 1 µL DMSO aliquot of a 40 µM stock solution of peptidomimetic macrocycle is dissolved in 19 µL of PBS (Phosphate-buffered saline: 50 mM, pH 7.5 Phosphate buffer containing 150 mM NaCl). The resulting solution is mixed by repeated pipetting and clarified by centrifugation at 10 000 g for 10 min. To a 4 µL aliquot of the resulting supernatant is added 4 µL of 10 µM hMDM2 in PBS. Each 8.0 µL experimental sample thus contains 40 pmol (1.5 µg) of protein at 5.0 µM concentration in PBS plus 1 µM peptidomimetic macrocycle and 2.5% DMSO. Duplicate samples thus prepared for each concentration point are incubated for 60 mM at room temperature, and then chilled to 4° C. prior to size-exclusion chromatography-LC-MS analysis of 5.0 µL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column. After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

Assay for Protein-Ligand Kd Titration Experiments.

To assess the binding and affinity of test compounds for proteins, a protein-ligand Kd titration experiment is performed, for example. Protein-ligand $K_d$ titrations experiments are conducted as follows: 2 µL DMSO aliquots of a serially diluted stock solution of titrant peptidomimetic macrocycle (5, 2.5, . . . , 0.098 mM) are prepared then dissolved in 38 µL of PBS. The resulting solutions are mixed by repeated pipetting and clarified by centrifugation at 10 000 g for 10 min. To 4.0 µL aliquots of the resulting supernatants is added 4.0 µL of 10 µM hMDM2 in PBS. Each 8.0 µL experimental sample thus contains 40 pmol (1.5 pig) of protein at 5.0 µM concentration in PBS, varying concentrations (125, 62.5, . . . , 0.24 µM) of the titrant peptide, and 2.5% DMSO. Duplicate samples thus prepared for each concentration point are incubated at room temperature for 30 min, then chilled to 4° C. prior to SEC-LC-MS analysis of 2.0 µL injections. The $(M+H)^{1+}$, $(M+2H)^{2+}$, $(M+3H)^{3+}$, and/or $(M+Na)^{1+}$ ion is observed by ESI-MS; extracted ion chromatograms are quantified, then fit to equations to derive the binding affinity $K_d$ as described in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Assay for Competitive Binding Experiments by Affinity Selection-Mass Spectrometry To determine the ability of test compounds to bind competitively to proteins, an affinity selection mass spectrometry assay is performed, for example. A mixture of ligands at 40 µM per component is prepared by combining 2 µL aliquots of 400 µM stocks of each of the three compounds with 14 µL of DMSO. Then, 1 µL aliquots of this 40 µM per component mixture are combined with 1 µL DMSO aliquots of a serially diluted stock solution of titrant peptidomimetic macrocycle (10, 5, 2.5, . . . , 0.078 mM). These 2 µL samples are dissolved in 38 µL of PBS. The resulting solutions were mixed by repeated pipetting and clarified by centrifugation at 10 000 g for 10 min. To 4.0 µL aliquots of the resulting supernatants is added 4.0 µL of 10 µM hMDM2 protein in PBS. Each 8.0 µL experimental sample thus contains 40 pmol (1.5 pig) of protein at 5.0 µM concentration in PBS plus 0.5 µM ligand, 2.5% DMSO, and varying concentrations (125, 62.5, . . . , 0.98 µM) of the titrant peptidomimetic macrocycle. Duplicate samples thus prepared for each concentration point are incubated at room temperature for 60 min, then chilled to 4° C. prior to SEC-LC-MS analysis of 2.0 µL injections. Additional details on these and other methods are provided in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Binding Assays in Intact Cells.

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µl goat anti-FITC antibody for 2 hrs, rotating at 4° C. followed by further 2 hrs incubation at 4° C. with protein A/G Sepharose (50 µl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

Cellular Penetrability Assays.

A peptidomimetic macrocycle is, for example, more cell penetrable compared to a corresponding uncrosslinked macrocycle. Peptidomimetic macrocycles with optimized linkers possess, for example, cell penetrability that is at least two-fold greater than a corresponding uncrosslinked macrocycle, and often 20% or more of the applied peptidomimetic macrocycle will be observed to have penetrated the cell after 4 hours. To measure the cell penetrability of peptidomimetic macrocycles and corresponding uncrosslinked macrocycle, intact cells are incubated with fluoresceinated peptidomimetic macrocycles or corresponding uncrosslinked macrocycle (10 µM) for 4 hrs in serum free media at 37° C., washed twice with media and incubated with trypsin (0.25%) for 10 mM at 37° C. The cells are washed again and resuspended in PBS. Cellular fluorescence is analyzed, for example, by using either a FACSCalibur flow cytometer or Cellomics' KineticScan HCS Reader.

Cellular Efficacy Assays.

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at EC50<10 µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

In Vivo Stability Assay.

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

In Vivo Efficacy in Animal Models.

To determine the anti-oncogenic activity of peptidomimetic macrocycles of the invention in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5 \times 10^6$ RS4; 11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, Mass.). Total body bioluminescence is quantified by integration of photonic flux (photons/sec) by Living Image Software (Caliper Life Sciences, Hopkinton, Mass.). Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma, that stably expresses luciferase. These in vivo tests optionally generate preliminary pharmacokinetic, pharmacodynamic and toxicology data.

Clinical Trials.

To determine the suitability of the peptidomimetic macrocycles of the invention for treatment of humans, clinical trials are performed. For example, patients diagnosed with cancer and in need of treatment are selected and separated in treatment and one or more control groups, wherein the treatment group is administered a peptidomimetic macrocycle of the invention, while the control groups receive a placebo or a known anti-cancer drug. The treatment safety and efficacy of the peptidomimetic macrocycles of the invention can thus be evaluated by performing comparisons of the patient groups with respect to factors such as survival and quality-of-life. In this example, the patient group treated with a peptidomimetic macrocyle show improved long-term survival compared to a patient control group treated with a placebo.

Pharmaceutical Compositions and Routes of Administration

The peptidomimetic macrocycles of the invention also include pharmaceutically acceptable derivatives or prodrugs thereof. A "pharmaceutically acceptable derivative" means any pharmaceutically acceptable salt, ester, salt of an ester, pro-drug or other derivative of a compound of this invention which, upon administration to a recipient, is capable of providing (directly or indirectly) a compound of this invention. Particularly favored pharmaceutically acceptable derivatives are those that increase the bioavailability of the compounds of the invention when administered to a mammal (e.g., by increasing absorption into the blood of an orally administered compound) or which increases delivery of the active compound to a biological compartment (e.g., the brain or lymphatic system) relative to the parent species. Some pharmaceutically acceptable derivatives include a chemical group which increases aqueous solubility or active transport across the gastrointestinal mucosa.

In some embodiments, the peptidomimetic macrocycles of the invention are modified by covalently or non-covalently joining appropriate functional groups to enhance selective biological properties. Such modifications include those which increase biological penetration into a given biological compartment (e.g., blood, lymphatic system, central nervous system), increase oral availability, increase solubility to allow administration by injection, alter metabolism, and alter rate of excretion.

Pharmaceutically acceptable salts of the compounds of this invention include those derived from pharmaceutically acceptable inorganic and organic acids and bases. Examples of suitable acid salts include acetate, adipate, benzoate, benzenesulfonate, butyrate, citrate, digluconate, dodecylsulfate, formate, fumarate, glycolate, hemisulfate, heptanoate, hexanoate, hydrochloride, hydrobromide, hydroiodide, lactate, maleate, malonate, methanesulfonate, 2-naphthalenesulfonate, nicotinate, nitrate, palmoate, phosphate, picrate, pivalate, propionate, salicylate, succinate, sulfate, tartrate, tosylate and undecanoate. Salts derived from appropriate bases include alkali metal (e.g., sodium), alkaline earth metal (e.g., magnesium), ammonium and N-(alkyl)$_4^+$ salts.

For preparing pharmaceutical compositions from the compounds of the present invention, pharmaceutically acceptable carriers include either solid or liquid carriers. Solid form preparations include powders, tablets, pills, capsules, cachets, suppositories, and dispersible granules. A solid carrier can be one or more substances, which also acts as diluents, flavoring agents, binders, preservatives, tablet disintegrating agents, or an encapsulating material. Details on techniques for formulation and administration are well described in the scientific and patent literature, see, e.g., the latest edition of Remington's Pharmaceutical Sciences, Maack Publishing Co, Easton Pa.

In powders, the carrier is a finely divided solid, which is in a mixture with the finely divided active component. In tablets, the active component is mixed with the carrier having the necessary binding properties in suitable proportions and compacted in the shape and size desired.

Suitable solid excipients are carbohydrate or protein fillers include, but are not limited to sugars, including lactose, sucrose, mannitol, or sorbitol; starch from corn, wheat, rice, potato, or other plants; cellulose such as methyl cellulose, hydroxypropylmethyl-cellulose, or sodium carboxymethylcellulose; and gums including arabic and tragacanth; as well as proteins such as gelatin and collagen. If desired, disintegrating or solubilizing agents are added, such as the cross-linked polyvinyl pyrrolidone, agar, alginic acid, or a salt thereof, such as sodium alginate.

Liquid form preparations include solutions, suspensions, and emulsions, for example, water or water/propylene glycol solutions. For parenteral injection, liquid preparations can be formulated in solution in aqueous polyethylene glycol solution.

The pharmaceutical preparation is preferably in unit dosage form. In such form the preparation is subdivided into unit doses containing appropriate quantities of the active component. The unit dosage form can be a packaged preparation, the package containing discrete quantities of preparation, such as packeted tablets, capsules, and powders in vials or ampoules. Also, the unit dosage form can be a capsule, tablet, cachet, or lozenge itself, or it can be the appropriate number of any of these in packaged form.

When the compositions of this invention comprise a combination of a peptidomimetic macrocycle and one or more additional therapeutic or prophylactic agents, both the compound and the additional agent should be present at dosage levels of between about 1 to 100%, and more preferably between about 5 to 95% of the dosage normally administered in a monotherapy regimen. In some embodiments, the additional agents are administered separately, as part of a multiple dose regimen, from the compounds of this invention. Alternatively, those agents are part of a single dosage form, mixed together with the compounds of this invention in a single composition.

Methods of Use

In one aspect, the present invention provides novel peptidomimetic macrocycles that are useful in competitive binding assays to identify agents which bind to the natural ligand(s) of the proteins or peptides upon which the peptidomimetic macrocycles are modeled. For example, in the p53/HDMX system, labeled peptidomimetic macrocycles based on p53 can be used in a HDMX binding assay along with small molecules that competitively bind to HDMX. Competitive binding studies allow for rapid in vitro evaluation and determination of drug candidates specific for the p53/HDMX system. Such binding studies may be performed with any of the peptidomimetic macrocycles disclosed herein and their binding partners.

The invention further provides for the generation of antibodies against the peptidomimetic macrocycles. In some embodiments, these antibodies specifically bind both the peptidomimetic macrocycle and the precursor peptides, such as p53, to which the peptidomimetic macrocycles are related. Such antibodies, for example, disrupt the native protein-protein interaction, for example, binding between p53 and HDMX.

In other aspects, the present invention provides for both prophylactic and therapeutic methods of treating a subject at risk of (or susceptible to) a disorder or having a disorder associated with aberrant (e.g., insufficient or excessive) expression or activity of the molecules including p53, HDM2 or HDMX.

In another embodiment, a disorder is caused, at least in part, by an abnormal level of p53 or HDM2 or HDMX, (e.g., over or under expression), or by the presence of p53 or HDM2 or HDMX exhibiting abnormal activity. As such, the reduction in the level and/or activity of p53 or HDM2 or HDMX, or the enhancement of the level and/or activity of p53 or HDM2 or HDMX, by peptidomimetic macrocycles derived from p53, is used, for example, to ameliorate or reduce the adverse symptoms of the disorder.

In another aspect, the present invention provides methods for treating or preventing a disease including hyperproliferative disease and inflammatory disorder by interfering with the interaction or binding between binding partners, for example, between p53 and HDM2 or p53 and HDMX. These methods comprise administering an effective amount of a compound of the invention to a warm blooded animal, including a human. In some embodiments, the administration of the compounds of the present invention induces cell growth arrest or apoptosis.

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

In some embodiments, the peptidomimetics macrocycles of the invention is used to treat, prevent, and/or diagnose cancers and neoplastic conditions. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states may be categorized as pathologic, i.e., characterizing or constituting a disease state, or may be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. A metastatic tumor can arise from a multitude of primary tumor types, including but not limited to those of breast, lung, liver, colon and ovarian origin. "Pathologic hyperproliferative" cells occur in disease states characterized by malignant tumor growth. Examples of non-pathologic hyperproliferative cells include proliferation of cells associated with wound repair. Examples of cellular proliferative and/or differentiative disorders include cancer, e.g., carcinoma, sarcoma, or metastatic disorders. In some embodiments, the peptidomimetics macrocycles are novel therapeutic agents for controlling breast cancer, ovarian cancer, colon cancer, lung cancer, metastasis of such cancers and the like.

Examples of cancers or neoplastic conditions include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

Examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991), *Crit Rev. Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but not limited to, gynecomastia and carcinoma.

Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors.

Examples of cellular proliferative and/or differentiative disorders of the ovary include, but are not limited to, ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

In other or further embodiments, the peptidomimetics macrocycles described herein are used to treat, prevent or diagnose conditions characterized by overactive cell death or cellular death due to physiologic insult, etc. Some examples of conditions characterized by premature or unwanted cell death are or alternatively unwanted or excessive cellular proliferation include, but are not limited to hypocellular/hypoplastic, acellular/aplastic, or hypercellular/hyperplastic conditions. Some examples include hematologic disorders including but not limited to fanconi anemia, aplastic anemia, thalaessemia, congenital neutropenia, and myelodysplasia.

In other or further embodiments, the peptidomimetics macrocycles of the invention that act to decrease apoptosis are used to treat disorders associated with an undesirable level of cell death. Thus, in some embodiments, the anti-apoptotic peptidomimetics macrocycles of the invention are used to treat disorders such as those that lead to cell death associated with viral infection, e.g., infection associated with infection with human immunodeficiency virus (HIV). A wide variety of neurological diseases are characterized by the gradual loss of specific sets of neurons. One example is Alzheimer's disease (AD). Alzheimer's disease is characterized by loss of neurons and synapses in the cerebral cortex and certain subcortical regions. This loss results in gross atrophy of the affected regions. Both amyloid plaques and neurofibrillary tangles are visible in brains of those afflicted by AD Alzheimer's disease has been identified as a protein misfolding disease, due to the accumulation of abnormally folded A-beta and tau proteins in the brain. Plaques are made up of β-amyloid. β-amyloid is a fragment from a larger protein called amyloid precursor protein (APP). APP is critical to neuron growth, survival and post-injury repair. In AD, an unknown process causes APP to be cleaved into smaller fragments by enzymes through proteolysis. One of these fragments is fibrils of β-amyloid, which form clumps that deposit outside neurons in dense formations known as senile plaques. Plaques continue to grow into insoluble twisted fibers within the nerve cell, often called tangles. Disruption of the interaction between β-amyloid and its native receptor is therefore important in the treatment of AD. The anti-apoptotic peptidomimetics macrocycles of the invention are used, in some embodiments, in the treatment of AD and other neurological disorders associated with cell apoptosis. Such neurological disorders include Alzheimer's disease, Parkinson's disease, amyotrophic lateral sclerosis (ALS) retinitis pigmentosa, spinal muscular atrophy, and various forms of cerebellar degeneration. The cell loss in these diseases does not induce an inflammatory response, and apoptosis appears to be the mechanism of cell death.

In addition, a number of hematologic diseases are associated with a decreased production of blood cells. These disorders include anemia associated with chronic disease, aplastic anemia, chronic neutropenia, and the myelodysplastic syndromes. Disorders of blood cell production, such as myelodysplastic syndrome and some forms of aplastic anemia, are associated with increased apoptotic cell death within the bone marrow. These disorders could result from the activation of genes that promote apoptosis, acquired deficiencies in stromal cells or hematopoietic survival factors, or the direct effects of toxins and mediators of immune responses. Two common disorders associated with cell death are myocardial infarctions and stroke. In both disorders, cells within the central area of ischemia, which is produced in the event of acute loss of blood flow, appear to die rapidly as a result of necrosis. However, outside the central ischemic zone, cells die over a more protracted time period and morphologically appear to die by apoptosis. In other or further embodiments, the anti-apoptotic peptidomimetics macrocycles of the invention are used to treat all such disorders associated with undesirable cell death.

Some examples of neurologic disorders that are treated with the peptidomimetics macrocycles described herein include but are not limited to Alzheimer's Disease, Down's Syndrome, Dutch Type Hereditary Cerebral Hemorrhage Amyloidosis, Reactive Amyloidosis, Familial Amyloid Nephropathy with Urticaria and Deafness, Muckle-Wells Syndrome, Idiopathic Myeloma; Macroglobulinemia-Associated Myeloma, Familial Amyloid Polyneuropathy, Familial Amyloid Cardiomyopathy, Isolated Cardiac Amyloid, Systemic Senile Amyloidosis, Adult Onset Diabetes, Insulinoma, Isolated Atrial Amyloid, Medullary Carcinoma of the Thyroid, Familial Amyloidosis, Hereditary Cerebral Hemorrhage With Amyloidosis, Familial Amyloidotic Polyneuropathy, Scrapie, Creutzfeldt-Jacob Disease, Gerstmann Straussler-Scheinker Syndrome, Bovine Spongiform Encephalitis, a prion-mediated disease, and Huntington's Disease.

In another embodiment, the peptidomimetics macrocycles described herein are used to treat, prevent or diagnose inflammatory disorders. Numerous types of inflammatory disorders exist. Certain inflammatory diseases are associated with the immune system, for example, autoimmune diseases. Autoimmune diseases arise from an overactive immune response of the body against substances and tissues normally present in the body, i.e. self antigens. In other words, the immune system attacks its own cells. Autoimmune diseases are a major cause of immune-mediated diseases. Rheumatoid arthritis is an example of an autoimmune disease, in which the immune system attacks the joints, where it causes inflammation (i.e. arthritis) and destruction. It can also damage some organs, such as the lungs and skin. Rheumatoid arthritis can lead to substantial loss of functioning and mobility. Rheumatoid arthritis is diagnosed with blood tests especially the rheumatoid factor test. Some examples of autoimmune diseases that are treated with the peptidomimetics macrocycles described herein include, but are not limited to, acute disseminated encephalomyelitis (ADEM), Addison's disease, ankylosing spondylitis, antiphospholipid antibody syndrome (APS), autoimmune hemolytic anemia, autoimmune hepatitis, autoimmune inner ear disease, Bechet's disease, bullous pemphigoid, coeliac disease, Chagas disease, Churg-Strauss syndrome, chronic obstructive pulmonary disease (COPD), Crohn's disease, dermatomyositis, diabetes mellitus type 1, endometriosis, Goodpasture's syndrome, Graves' disease, Guillain-Barré syndrome (GBS), Hashimoto's disease, Hidradenitis suppurativa, idiopathic thrombocytopenic purpura, inflammatory bowel disease (IBD), interstitial cystitis, lupus erythematosus, morphea, multiple sclerosis, myasthenia gravis, narcolepsy, neuromyotonia, pemphigus vulgaris, pernicious anaemia, Polymyositis, polymyalgia rheumatica, primary biliary cirrhosis, psoriasis, rheumatoid arthritis, schizophrenia, scleroderma, Sjögren's syndrome, temporal arteritis (also known as "giant cell arteritis"), Takayasu's arteritis, Vasculitis, Vitiligo, and Wegener's granulomatosis.

Some examples of other types of inflammatory disorders that are treated with the peptidomimetics macrocycles described herein include, but are not limited to, allergy including allergic rhinitis/sinusitis, skin allergies (urticaria/hives, angioedema, atopic dermatitis), food allergies, drug allergies, insect allergies, and rare allergic disorders such as mastocytosis, asthma, arthritis including osteoarthritis, rheumatoid arthritis, and spondyloarthropathies, primary angitis of the CNS, sarcoidosis, organ transplant rejection, fibromyalgia, fibrosis, pancreatitis, and pelvic inflammatory disease.

Examples of cardiovascular disorders (e.g., inflammatory disorders) that are treated or prevented with the peptidomimetics macrocycles of the invention include, but are not limited to, aortic valve stenosis, atherosclerosis, myocardial infarction, stroke, thrombosis, aneurism, heart failure, ischemic heart disease, angina pectoris, sudden cardiac death, hypertensive heart disease; non-coronary vessel disease, such as arteriolosclerosis, small vessel disease, nephropathy, hypertriglyceridemia, hypercholesterolemia, hyperlipidemia, xanthomatosis, asthma, hypertension, emphysema and chronic pulmonary disease; or a cardiovascular condition associated with interventional procedures ("procedural vascular trauma"), such as restenosis following angioplasty, placement of a shunt, stent, synthetic or natural excision grafts, indwelling catheter, valve or other implantable devices. Preferred cardiovascular disorders include atherosclerosis, myocardial infarction, aneurism, and stroke.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

EXAMPLES
Example 1: Synthesis of 6-Chlorotryptophan Fmoc Amino Acids
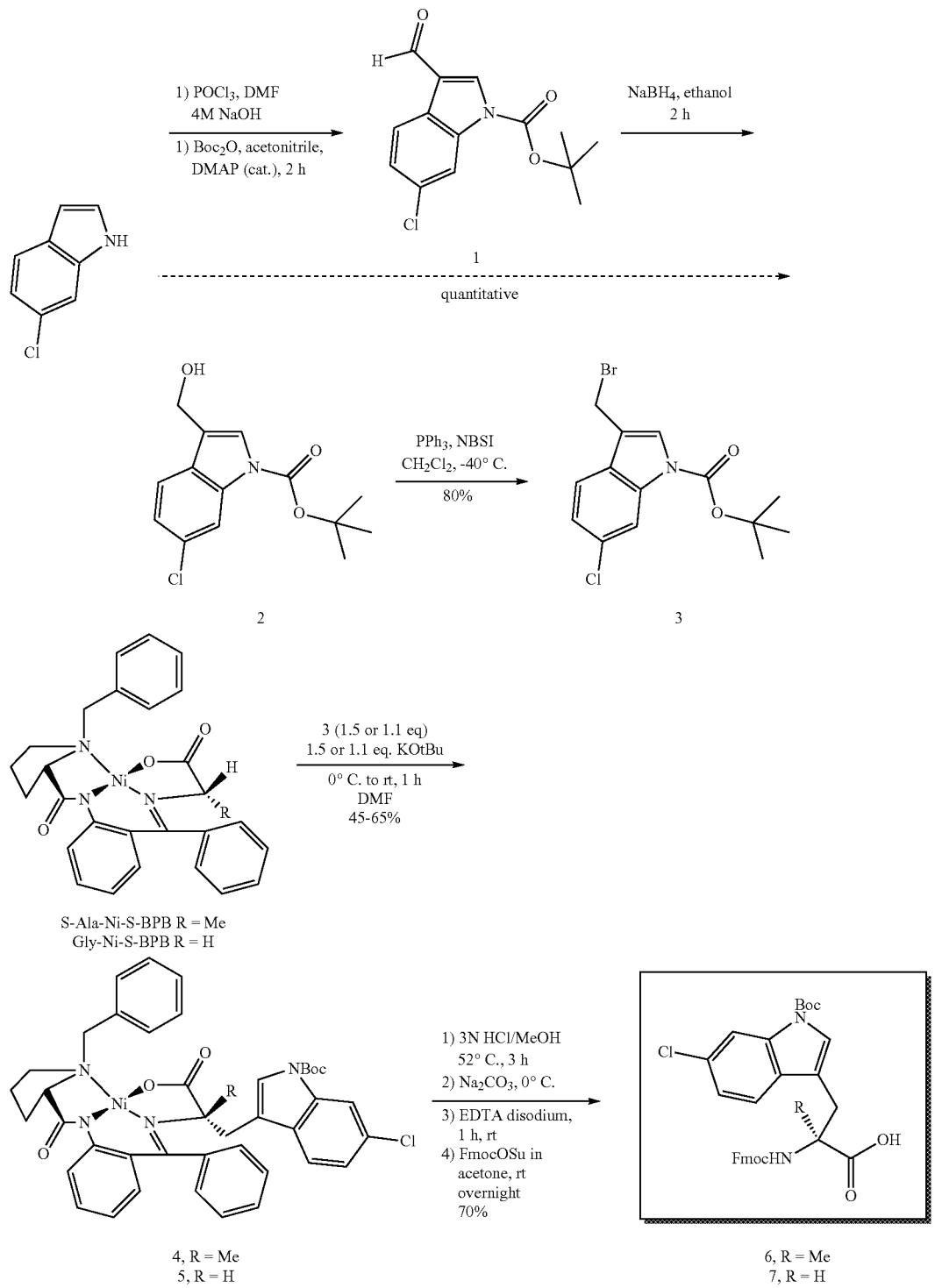
Tert-butyl 6-chloro-3-formyl-1H-indole-1-carboxylate, 1. To a stirred solution of dry DMF (12 mL) was added dropwise POCl$_3$ (3.92 mL, 43 mmol, 1.3 equiv) at 0° C. under Argon. The solution was stirred at the same temperature for 20 min before a solution of 6-chloroindole (5.0 g, 33 mmol, 1 eq.) in dry DMF (30 mL) was added dropwise. The resulting mixture was allowed to warm to room temperature and stirred for an additional 2.5 h. Water (50 mL) was added and the solution was neutralized with 4M aqueous NaOH (pH~8). The resulting solid was filtered off, washed with water and dried under vacuum. This material was directly used in the next step without additional purification. To a stirred solution of the crude formyl indole (33 mmol, 1 eq.) in THF (150 mL) was added successively Boc$_2$O (7.91 g, 36.3 mmol, 1.1 equiv) and DMAP (0.4 g, 3.3 mmol, 0.1 equiv) at room temperature under N$_2$. The resulting mixture was stirred at room temperature for 1.5 h and the solvent was evaporated under reduced pressure. The residue was taken up in EtOAc and washed with 1N HCl, dried and concentrated to give the formyl indole 1 (9 g, 98% over 2 steps) as a white solid. $^1$H NMR (CDCl$_3$) δ: 1.70 (s, Boc, 9H); 7.35 (dd, 1H); 8.21 (m, 3H); 10.07 (s, 1H).

Tert-butyl 6-chloro-3-(hydroxymethyl)-1H-indole-1-carboxylate, 2. To a solution of compound 1 (8.86 g, 32 mmol, 1 eq.) in ethanol (150 mL) was added NaBH$_4$ (2.4 g, 63 mmol, 2 eq.). The reaction was stirred for 3 h at room temperature. The reaction mixture was concentrated and the residue was poured into diethyl ether and water. The organic layer was separated, dried over magnesium sulfate and concentrated to give a white solid (8.7 g, 98%). This material was directly used in the next step without additional purification. $^1$H NMR (CDCl$_3$) δ: 1.65 (s, Boc, 9H); 4.80 (s, 2H, CH$_2$); 7.21 (dd, 1H); 7.53 (m, 2H); 8.16 (bs, 1H).

Tert-butyl 3-(bromomethyl)-6-chloro-1H-indole-1-carboxylate, 3. To a solution of compound 2 (4.1 g, 14.6 mmol, 1 eq.) in dichloromethane (50 mL) under argon was added a solution of triphenylphosphine (4.59 g, 17.5 mmol, 1.2 eq.) in dichloromethane (50 mL) at −40° C. The reaction solution was stirred an additional 30 min at 40° C. Then NBS (3.38 g, 19 mmol, 1.3 eq.) was added. The resulting mixture was allowed to warm to room temperature and stirred overnight. Dichloromethane was evaporated, Carbon Tetrachloride (100 mL) was added and the mixture was stirred for 1 h and filtrated. The filtrate was concentrated, loaded in a silica plug and quickly eluted with 25% EtOAc in Hexanes. The solution was concentrated to give a white foam (3.84 g, 77%). $^1$H NMR (CDCl$_3$) δ: 1.66 (s, Boc, 9H); 4.63 (s, 2H, CH$_2$); 7.28 (dd, 1H); 7.57 (d, 1H); 7.64 (bs, 1H); 8.18 (bs, 1H).

αMe-6Cl-Trp(Boc)-Ni—S—BPB, 4. To S-Ala-Ni—S—BPB (2.66 g, 5.2 mmol, 1 eq.) and KO-tBu (0.87 g, 7.8 mmol, 1.5 eq.) was added 50 mL of DMF under argon. The bromide derivative compound 3 (2.68 g, 7.8 mmol, 1.5 eq.) in solution of DMF (5.0 mL) was added via syringe. The reaction mixture was stirred at ambient temperature for 1 h. The solution was then quenched with 5% aqueous acetic acid and diluted with water. The desired product was extracted in dichloromethane, dried and concentrated. The oily product 4 was purified by flash chromatography (solid loading) on normal phase using EtOAc and Hexanes as eluents to give a red solid (1.78 g, 45% yield). αMe-6Cl-Trp(Boc)-Ni—S—BPB, 4: M+H calc. 775.21, M+H obs. 775.26; $^1$H NMR (CDCl$_3$) δ: 1.23 (s, 3H, αMe); 1.56 (m, 11H, Boc+CH$_2$); 1.82-2.20 (m, 4H, 2CH$_2$); 3.03 (m, 1H, CH$_α$); 3.24 (m, 2H, CH$_2$); 3.57 and 4.29 (AB system, 2H, CH$_2$ (benzyl), J=12.8 Hz); 6.62 (d, 2H); 6.98 (d, 1H); 7.14 (m, 2H); 7.23 (m, 1H); 7.32-7.36 (m, 5H); 7.50 (m, 2H); 7.67 (bs, 1H); 7.98 (d, 2H); 8.27 (m, 2H).

Fmoc-αMe-6Cl-Trp(Boc)-OH, 6. To a solution of 3N HCl/MeOH (1/3, 15 mL) at 50° C. was added a solution of compound 4 (1.75 g, 2.3 mmol, 1 eq.) in MeOH (5 ml) dropwise. The starting material disappeared within 3-4 h. The acidic solution was then cooled to 0° C. with an ice bath and quenched with an aqueous solution of Na$_2$CO$_3$ (1.21 g, 11.5 mmol, 5 eq.). Methanol was removed and 8 more equivalents of Na$_2$CO$_3$ (1.95 g, 18.4 mmol) were added to the suspension. The Nickel scavenging EDTA disodium salt dihydrate (1.68 g, 4.5 mmol, 2 eq.) was then added and the suspension was stirred for 2 h. A solution of Fmoc-OSu (0.84 g, 2.5 mmol, 1.1 eq.) in acetone (50 mL) was added and the reaction was stirred overnight. Afterwards, the reaction was diluted with diethyl ether and 1N HCl. The organic layer was then dried over magnesium sulfate and concentrated in vacuo. The desired product 6 was purified on normal phase using acetone and dichloromethane as eluents to give a white foam (0.9 g, 70% yield). Fmoc-αMe-6Cl-Trp(Boc)-OH, 6: M+H calc. 575.19, M+H obs. 575.37; $^1$H NMR (CDCl$_3$) 1.59 (s, 9H, Boc); 1.68 (s, 3H, Me); 3.48 (bs, 2H, CH$_2$); 4.22 (m, 1H, CH); 4.39 (bs, 2H, CH$_2$); 5.47 (s, 1H, NH); 7.10 (m, 1H); 7.18 (m, 2H); 7.27 (m, 2H); 7.39 (m, 2H); 7.50 (m, 2H); 7.75 (d, 2H); 8.12 (bs, 1H).

6Cl-Trp(Boc)-Ni—S—BPB, 5. To Gly-Ni—S—BPB (4.6 g, 9.2 mmol, 1 eq.) and KO-tBu (1.14 g, 10.1 mmol, 1.1 eq.) was added 95 mL of DMF under argon. The bromide derivative compound 3 (3.5 g, 4.6 mmol, 1.1 eq.) in solution of DMF (10 mL) was added via syringe. The reaction mixture was stirred at ambient temperature for 1 h. The solution was then quenched with 5% aqueous acetic acid and diluted with water. The desired product was extracted in dichloromethane, dried and concentrated. The oily product 5 was purified by flash chromatography (solid loading) on normal phase using EtOAc and Hexanes as eluents to give a red solid (5 g, 71% yield). 6Cl-Trp(Boc)-Ni—S—BPB, 5: M+H calc. 761.20, M+H obs. 761.34; $^1$H NMR (CDCl$_3$) δ: 1.58 (m, 11H, Boc+CH$_2$); 1.84 (m, 1H); 1.96 (m, 1H); 2.24 (m, 2H, CH$_2$); 3.00 (m, 1H, CH$_α$); 3.22 (m, 2H, CH$_2$); 3.45 and 4.25 (AB system, 2H, CH$_2$ (benzyl), J=12.8 Hz); 4.27 (m, 1H, CH$_α$); 6.65 (d, 2H); 6.88 (d, 1H); 7.07 (m, 2H); 7.14 (m, 2H); 7.28 (m, 3H); 7.35-7.39 (m, 2H); 7.52 (m, 2H); 7.96 (d, 2H); 8.28 (m, 2H).

Fmoc-6Cl-Trp(Boc)-OH, 7. To a solution of 3N HCl/MeOH (1/3, 44 mL) at 50° C. was added a solution of compound 5 (5 g, 6.6 mmol, 1 eq.) in MeOH (10 ml) dropwise. The starting material disappeared within 3-4 h. The acidic solution was then cooled to 0° C. with an ice bath and quenched with an aqueous solution of Na$_2$CO$_3$ (3.48 g, 33 mmol, 5 eq.). Methanol was removed and 8 more equivalents of Na$_2$CO$_3$ (5.57 g, 52 mmol) were added to the suspension. The Nickel scavenging EDTA disodium salt dihydrate (4.89 g, 13.1 mmol, 2 eq.) and the suspension was stirred for 2 h. A solution of Fmoc-OSu (2.21 g, 6.55 mmol, 1.1 eq.) in acetone (100 mL) was added and the reaction was stirred overnight. Afterwards, the reaction was diluted with diethyl ether and 1N HCl. The organic layer was then dried over magnesium sulfate and concentrated in vacuo. The desired product 7 was purified on normal phase using acetone and dichloromethane as eluents to give a white foam (2.6 g, 69% yield). Fmoc-6Cl-Trp(Boc)-OH, 7: M+H calc. 561.17, M+H obs. 561.37; $^1$H NMR (CDCl$_3$) 1.63 (s, 9H, Boc); 3.26 (m, 2H, CH$_2$); 4.19 (m, 1H, CH); 4.39 (m, 2H, CH$_2$); 4.76 (m, 1H); 5.35 (d, 1H, NH); 7.18 (m, 2H); 7.28 (m, 2H); 7.39 (m, 3H); 7.50 (m, 2H); 7.75 (d, 2H); 8.14 (bs, 1H).

Example 2: Peptidomimetic Macrocycles of the Invention

Peptidomimetic macrocycles were synthesized, purified and analyzed as previously described and as described below (Schafmeister et al., J. Am. Chem. Soc. 122:5891-

5892 (2000); Schafmeister & Verdine, J. Am. Chem. Soc. 122:5891 (2005); Walensky et al., Science 305:1466-1470 (2004); and U.S. Pat. No. 7,192,713). Peptidomimetic macrocycles were designed by replacing two or more naturally occurring amino acids with the corresponding synthetic amino acids. Substitutions were made at i and i+4, and i and i+7 positions. Peptide synthesis was performed either manually or on an automated peptide synthesizer (Applied Biosystems, model 433A), using solid phase conditions, rink amide AM resin (Novabiochem), and Fmoc main-chain protecting group chemistry. For the coupling of natural Fmoc-protected amino acids (Novabiochem), 10 equivalents of amino acid and a 1:1:2 molar ratio of coupling reagents HBTU/HOBt (Novabiochem)/DIEA were employed. Non-natural amino acids (4 equiv) were coupled with a 1:1:2 molar ratio of HATU (Applied Biosystems)/HOBt/DIEA. The N-termini of the synthetic peptides were acetylated, while the C-termini were amidated.

Purification of cross-linked compounds was achieved by high performance liquid chromatography (HPLC) (Varian ProStar) on a reverse phase C18 column (Varian) to yield the pure compounds. Chemical composition of the pure products was confirmed by LC/MS mass spectrometry (Micromass LCT interfaced with Agilent 1100 HPLC system) and amino acid analysis (Applied Biosystems, model 420A).

Table 4 shows a list of peptidomimetic macrocycles of the invention prepared.

TABLE 4

| SEQ ID NO: | SP | Seq | Exact Mass | M + 2 | Observed mass (m/e) |
|---|---|---|---|---|---|
| 38 | SP-1 | Ac-LSQETF$r8DLWKLL$EN-NH2 | 2068.13 | 1035.07 | 1035.36 |
| 39 | SP-2 | Ac-LSQETF$r8NLWKLL$QN-NH2 | 2066.16 | 1034.08 | 1034.31 |
| 40 | SP-3 | Ac-LSQQTF$r8NLWRLL$QN-NH2 | 2093.18 | 1047.59 | 1047.73 |
| 41 | SP-4 | Ac-QSQQTF$r8NLWKLL$QN-NH2 | 2080.15 | 1041.08 | 1041.31 |
| 42 | SP-5 | Ac-QSQQTF$r8NLWRLLSNH2 | 2108.15 | 1055.08 | 1055.32 |
| 43 | SP-6 | Ac-QSQQTA$r8NLWRLL$QN-NH2 | 2032.12 | 1017.06 | 1017.24 |
| 44 | SP-7 | Ac-QAibQQTF$r8NLWRLL$QN-NH2 | 2106.17 | 1054.09 | 1054.34 |
| 45 | SP-8 | Ac-QSQQTFSNLWRLLPQN-NH2 | 2000.02 | 1001.01 | 1001.26 |
| 46 | SP-9 | Ac-QSQQTF$/r8NLWRLLVQN-NH2 | 2136.18 | 1069.09 | 1069.37 |
| 47 | SP-10 | Ac-QSQAibTF$r8NLWRLL$QN-NH2 | 2065.15 | 1033.58 | 1033.71 |
| 48 | SP-11 | Ac-QSQQTF$r8NLWRLL$AN-NH2 | 2051.13 | 1026.57 | 1026.70 |
| 49 | SP-12 | Ac-ASQQTF$r8NLWRLL$QN-NH2 | 2051.13 | 1026.57 | 1026.90 |
| 50 | SP-13 | Ac-QSQQTF$r8ALWRLL$QN-NH2 | 2065.15 | 1033.58 | 1033.41 |
| 51 | SP-14 | Ac-QSQETF$r8NLWRLL$QN-NH2 | 2109.14 | 1055.57 | 1055.70 |
| 52 | SP-15 | Ac-RSQQTF$r8NLWRLL$QN-NH2 | 2136.20 | 1069.10 | 1069.17 |
| 53 | SP-16 | Ac-RSQQTF$r8NLWRLL$EN-NH2 | 2137.18 | 1069.59 | 1069.75 |
| 54 | SP-17 | Ac-LSQETFSDLWKLLPEN-NH2 | 1959.99 | 981.00 | 981.24 |
| 55 | SP-18 | Ac-QSQ$TFS$LWRLLPQN-NH2 | 2008.09 | 1005.05 | 1004.97 |
| 56 | SP-19 | Ac-QSQQ$FSN$WRLLPQN-NH2 | 2036.06 | 1019.03 | 1018.86 |
| 57 | SP-20 | Ac-QSQQT$SNL$RLLPQN-NH2 | 1917.04 | 959.52 | 959.32 |
| 58 | SP-21 | Ac-QSQQTF$NLW$LLPQN-NH2 | 2007.06 | 1004.53 | 1004.97 |
| 59 | SP-22 | Ac-RTQATF$r8NQWAibANle$TNAibTR-NH2 | 2310.26 | 1156.13 | 1156.52 |
| 60 | SP-23 | Ac-QSQQTF$r8NLWRLL$RN-NH2 | 2136.20 | 1069.10 | 1068.94 |
| 61 | SP-24 | Ac-QSQRTF$r8NLWRLL$QN-NH2 | 2136.20 | 1069.10 | 1068.94 |
| 62 | SP-25 | Ac-QSQQTF$r8NNleWRLL$QN-NH2 | 2108.15 | 1055.08 | 1055.44 |
| 63 | SP-26 | Ac-QSQQTF$r8NLWRNleL$QN-NH2 | 2108.15 | 1055.08 | 1055.84 |
| 64 | SP-27 | Ac-QSQQTF$r8NLWRLNle$QN-NH2 | 2108.15 | 1055.08 | 1055.12 |
| 65 | SP-28 | Ac-QSQQTY$r8NLWRLL$QN-NH2 | 2124.15 | 1063.08 | 1062.92 |
| 66 | SP-29 | Ac-RAibQQTF$r8NLWRLL$QN-NH2 | 2134.22 | 1068.11 | 1068.65 |

TABLE 4-continued

| SEQ ID NO: | SP | Seq | Exact Mass | M + 2 | Observed mass (m/e) |
|---|---|---|---|---|---|
| 67 | SP-30 | Ac-MPRFMDYWEGLN-NH2 | 1598.70 | 800.35 | 800.45 |
| 68 | SP-31 | Ac-RSQQRF$r8NLWRLL$QN-NH2 | 2191.25 | 1096.63 | 1096.83 |
| 69 | SP-32 | Ac-QSQQRF$r8NLWRLL$QN-NH2 | 2163.21 | 1082.61 | 1082.87 |
| 70 | SP-33 | Ac-RAibQQRF$r8NLWRLL$QN-NH2 | 2189.27 | 1095.64 | 1096.37 |
| 71 | SP-34 | Ac-RSQQRF$r8NFWRLL$QN-NH2 | 2225.23 | 1113.62 | 1114.37 |
| 72 | SP-35 | Ac-RSQQRF$r8NYWRLL$QN-NH2 | 2241.23 | 1121.62 | 1122.37 |
| 73 | SP-36 | Ac-RSQQTF$r8NLWQLL$QN-NH2 | 2108.15 | 1055.08 | 1055.29 |
| 74 | SP-37 | Ac-QSQQTF$r8NLWQAmlL$QN-NH2 | 2094.13 | 1048.07 | 1048.32 |
| 75 | SP-38 | Ac-QSQQTF$r8NAmlWRLL$QN-NH2 | 2122.17 | 1062.09 | 1062.35 |
| 76 | SP-39 | Ac-NlePRF$r8DYWEGL$QN-NH2 | 1869.98 | 935.99 | 936.20 |
| 77 | SP-40 | Ac-NlePRF$r8NYWRLL$QN-NH2 | 1952.12 | 977.06 | 977.35 |
| 78 | SP-41 | Ac-RF$r8NLWRLL$Q-NH2 | 1577.96 | 789.98 | 790.18 |
| 79 | SP-42 | Ac-QSQQTF$r8N2ffWRLL$QN-NH2 | 2160.13 | 1081.07 | 1081.40 |
| 80 | SP-43 | Ac-QSQQTF$r8N3ffWRLL$QN-NH2 | 2160.13 | 1081.07 | 1081.34 |
| 81 | SP-44 | Ac-QSQQTF#r8NLWRLL#QN-NH2 | 2080.12 | 1041.06 | 1041.34 |
| 82 | SP-45 | Ac-RSQQTA$r8NLWRLL$QN-NH2 | 2060.16 | 1031.08 | 1031.38 |
| 83 | SP-46 | Ac-QSQQTF%r8NLWRLL%QN-NH2 | 2110.17 | 1056.09 | 1056.55 |
| 84 | SP-47 | HepQSQ$TFSNLWRLLPQN-NH2 | 2051.10 | 1026.55 | 1026.82 |
| 85 | SP-48 | HepQSQ$TF$r8NLWRLL$QN-NH2 | 2159.23 | 1080.62 | 1080.89 |
| 86 | SP-49 | Ac-QSQQTF$r8NL6clWRLL$QN-NH2 | 2142.11 | 1072.06 | 1072.35 |
| 87 | SP-50 | Ac-QSQQTF$r8NLMe6clwRLL$QN-NH2 | 2156.13 | 1079.07 | 1079.27 |
| 88 | SP-51 | Ac-LTFEHYWAQLTS-NH2 | 1535.74 | 768.87 | 768.91 |
| 89 | SP-52 | Ac-LTF$HYW$QLTS-NH2 | 1585.83 | 793.92 | 794.17 |
| 90 | SP-53 | Ac-LTFE$YWA$LTS-NH2 | 1520.79 | 761.40 | 761.67 |
| 91 | SP-54 | Ac-LTF$zr8HYWAQL$zS-NH2 | 1597.87 | 799.94 | 800.06 |
| 92 | SP-55 | Ac-LTF$r8HYWRQL$S-NH2 | 1682.93 | 842.47 | 842.72 |
| 93 | SP-56 | Ac-QS$QTFStNLWRLL$s8QN-NH2 | 2145.21 | 1073.61 | 1073.90 |
| 94 | SP-57 | Ac-QSQQTASNLWRLLPQN-NH2 | 1923.99 | 963.00 | 963.26 |
| 95 | SP-58 | Ac-QSQQTA$/r8NLWRLL$/QN-NH2 | 2060.15 | 1031.08 | 1031.24 |
| 96 | SP-59 | Ac-ASQQTFS/r8NLWRLLS/QN-NH2 | 2079.16 | 1040.58 | 1040.89 |
| 97 | SP-60 | Ac-SSQQSFSNLWRLLAibQN-NH2 | 2009.09 | 1005.55 | 1005.86 |
| 98 | SP-61 | Ac-QSSQTFSNLWRLLAihQN-NH2 | 2023.10 | 1012.55 | 1012.79 |
| 99 | SP-62 | Ac-QSQQ$FSNSWRLLAibQN-NH2 | 2024.06 | 1013.03 | 1013.31 |
| 100 | SP-63 | Ac-QSQQTFSNLWSLLAibQN-NH2 | 1995.06 | 998.53 | 998.87 |
| 101 | SP-64 | Ac-QSQQTFSSLWRSLAibQN-NH2 | 2011.00 | 1006.53 | 1006.83 |
| 102 | SP-65 | Ac-QSQQTFSNLWSLLA$N-NH2 | 1940.02 | 971.01 | 971.29 |
| 103 | SP-66 | Ac-S/SQQ$/FSNLWRLLAibQN-NH2 | 2037.12 | 1019.56 | 1019.78 |
| 104 | SP-67 | Ac-QSyQTFVNLWRLLAibQN-NH2 | 2051.13 | 1026.57 | 1026.90 |
| 105 | SP 68 | Ac-QSQQ$/FSN$/WRLLAihQN-NH2 | 2052.09 | 1027.05 | 1027.36 |

TABLE 4-continued

| SEQ ID NO: | SP | Seq | Exact Mass | M + 2 | Observed mass (m/e) |
|---|---|---|---|---|---|
| 106 | SP-69 | Ac-QSQQTFS/NLWS/LLAibQN-NH2 | 2023.09 | 1012.55 | 1013.82 |
| 107 | SP-70 | Ac-QSQSTFSSLWRLLAibQN-NH2 | 1996.09 | 999.05 | 999.39 |
| 108 | SP-71 | Ac-QSQS/TFSS/LWRLLAibQN-NH2 | 2024.12 | 1013.06 | 1013.37 |
| 109 | SP-72 | Ac-QSS/QTFSt//WRLLS/s8QN-NH2 | 2201.27 | 1101.64 | 1102.00 |
| 110 | SP-73 | Ac-Sr8SQQTFSSLWRLLAibQN-NH2 | 2038.14 | 1020.07 | 1020.23 |
| 111 | SP-74 | Ac-QSQSr8TFSNLWSLLAibQN-NH2 | 1996.08 | 999.04 | 999.32 |
| 112 | SP-75 | Ac-QSQQTFSSr8LWRLLASN-NH2 | 2024.12 | 1013.06 | 1013.37 |
| 113 | SP-76 | Ac-QS$r5QTFStNLWSLLAibQN-NH2 | 2032.12 | 1017.06 | 1017.39 |
| 114 | SP-77 | Ac-S/r8SQQTFS$/LWRLLAibQN-NH2 | 2066.17 | 1034.09 | 1034.80 |
| 115 | SP-78 | Ac-QSQS/r8TKSNLWS/LLAibQN-NH2 | 2024.11 | 1013.06 | 1014.34 |
| 116 | SP-79 | Ac QSQQMSvYNLWRIIAS/N-NH2 | 2052.15 | 1027.08 | 1027.16 |
| 117 | SP-80 | Ac-QSS/r5QTPSt//NLWS/LLAibQN-NH2 | 2088.18 | 1045.09 | 1047.10 |
| 118 | SP-81 | Ac-QSQQTFSNLWRLLAihQN-NH2 | 1988.02 | 995.01 | 995.31 |
| 119 | SP-82 | HEp/QSQS/TFS/r8NLWRLLS/QN-NH2 | 2215.29 | 1108.65 | 1108.93 |
| 120 | SP-83 | Ac ASQQTFSiSNLRWLLSQNNH2 | 2051.13 | 1026.57 | 1026.90 |
| 121 | SP-84 | Ac-QSQQTFS/r8NLWRLLS/Q-NH2 | 2022.14 | 1012.07 | 1012.66 |
| 122 | SP-85 | Ac-QSQQTFSr8NLWRLLSQ-NH2 | 1994.11 | 998.06 | 998.42 |
| 123 | SP-86 | Ac-AAARAASr8AAARAASAA-NH2 | 1515.90 | 758.95 | 759.21 |
| 124 | SP-87 | Ac LTFEHYWAQLTSA-NH2 | 1606.78 | 804.39 | 804.59 |
| 125 | SP-8S | Ac-LTKSr8HYWAQLSSA-NH2 | 1668.90 | 835.45 | 835.67 |
| 126 | SP-89 | Ac-ASQQTKSNLWRLLPQN NH2 | 1943.00 | 972.50 | 973.27 |
| 127 | SP-90 | Ac-QS$QTFSTNLW$r5LLAibQN-NH2 | 2032.12 | 1017.06 | 1017.30 |
| 128 | SP 91 | Ac QSQQTFAiBNLWRLLAibQN-NH2 | 1986.04 | 994.02 | 99 1.19 |
| 129 | SP-92 | Ac-QSQQTFNleNLWRLLNIeQN-NH2 | 2042.11 | 1022.06 | 1022.23 |
| 130 | SP-93 | Ac-QSQQTFS/r8NLWRLLAibQN-NH2 | 2082.14 | 1042.07 | 1042.23 |
| 131 | SP-94 | Ac-QSQQTFS/r8NLWRLLNIcQN-NH2 | 2110.17 | 1056.09 | 1056.29 |
| 132 | SP-95 | Ac-QSQQTKAibNLWRLLS/QN-NH2 | 2040.09 | 1021.05 | 1021.25 |
| 133 | SP-96 | Ac-QSQQTFNlENLWRLLS/QN-NH2 | 2068.12 | 1035.06 | 1035.31 |
| 134 | SP-97 | Ac-QSQQTF%r8NL6cLWRNleL%QN-NH2 | 2144.13 | 1073.07 | 1073.32 |
| 135 | SP-98 | Ac-QSQQTF%r8NLMe6clWRLL%QN-NH2 | 2158.15 | 1080.08 | 1080.31 |
| 136 | SP-101 | Ac-FNle$YWE$L-NH2 | 1160.63 | — | 1161.70 |
| 137 | SP-102 | Ac-F$r8AYWELL$A-NH2 | 1344.75 | — | 1345.90 |
| 138 | SP-103 | Ac-F$r8AYWQLL$A-NH2 | 1343.76 | — | 1344.83 |
| 139 | SP-104 | Ac-NlePRF$r8NYWELL$QN-NH2 | 1925.06 | 963.53 | 963.69 |
| 140 | SP-105 | Ac-NlePRF$r8DYWRLL$QN-NH2 | 1953.10 | 977.55 | 977.68 |
| 141 | SP-106 | Ac-NlePRF$r8NYWRLL$Q-NH2 | 1838.07 | 920.04 | 920.18 |
| 142 | SP-107 | Ac-NlePRF$r8NYWRLL$-NH2 | 1710.01 | 856.01 | 856.13 |
| 143 | SP-108 | Ac-QSQQTF$r8DLWRLL$QN-NH2 | 2109.14 | 1055.57 | 1055.64 |

TABLE 4-continued

| SEQ ID NO: | SP | Seq | Exact Mass | M + 2 | Observed mass (m/e) |
|---|---|---|---|---|---|
| 144 | SP-109 | Ac-QSQQTF$r8NLWRLL$EN-NH2 | 2109.14 | 1055.57 | 1055.70 |
| 145 | SP-110 | Ac-QSQQTF$r8NLWRLL$QD-NH2 | 2109.14 | 1055.57 | 1055.64 |
| 146 | SP-111 | Ac-QSQQTF$r8NLWRLL$S-NH2 | 1953.08 | 977.54 | 977.60 |
| 147 | SP-112 | Ac-ESQQTF$r8NLWRLL$QN-NH2 | 2109.14 | 1055.57 | 1055.70 |
| 148 | SP-113 | Ac-LTF$r8NLWRNleL$Q-NH2 | 1635.99 | 819.00 | 819.10 |
| 149 | SP-114 | Ac-LRF$r8NLWRNleL$Q-NH2 | 1691.04 | 846.52 | 846.68 |
| 150 | SP-115 | Ac-QSQQTF$r8NWWRNleL$QN-NH2 | 2181.15 | 1091.58 | 1091.64 |
| 151 | SP-116 | Ac-QSQQTF$r8NLWRNleL$Q-NH2 | 1994.11 | 998.06 | 998.07 |
| 152 | SP-117 | Ac-QTF$r8NLWRNleL$QN-NH2 | 1765.00 | 883.50 | 883.59 |
| 153 | SP-118 | Ac-NlePRF$r8NWWRLL$QN-NH2 | 1975.13 | 988.57 | 988.75 |
| 154 | SP-119 | Ac-NlePRF$r8NWWRLL$A-NH2 | 1804.07 | 903.04 | 903.08 |
| 155 | SP-120 | Ac-TSFAEYWNLLSP-NH2 | 1467.70 | 734.85 | 734.90 |
| 156 | SP-121 | Ac-QTF$r8HWWSQL$S-NH2 | 1651.85 | 826.93 | 827.12 |
| 157 | SP-122 | Ac-FM$YWE$L-NH2 | 1178.58 | — | 1179.64 |
| 158 | SP-123 | Ac-QTFEHWWSQLLS-NH2 | 1601.76 | 801.88 | 801.94 |
| 159 | SP-124 | Ac-QSQQTF$r8NLAmwRLNle$QN-NH2 | 2122.17 | 1062.09 | 1062.24 |
| 160 | SP-125 | Ac-FMAibY6clWEAc3cL-NH2 | 1130.47 | — | 1131.53 |
| 161 | SP-126 | Ac-FNle$Y6clWE$L-NH2 | 1194.59 | — | 1195.64 |
| 162 | SP-127 | Ac-F$zr8AY6clWEAc3cL$z-NH2 | 1277.63 | 639.82 | 1278.71 |
| 163 | SP-128 | Ac-F$r8AY6clWEAc3cL$A-NH2 | 1348.66 | — | 1350.72 |
| 164 | SP-129 | Ac-NlePRF$r8NY6clWRLL$QN-NH2 | 1986.08 | 994.04 | 994.64 |
| 165 | SP-130 | Ac-AF$r8AAWALA$A-NH2 | 1223.71 | — | 1224.71 |
| 166 | SP-131 | Ac-TF$r8AAWRLA$Q-NH2 | 1395.80 | 698.90 | 399.04 |
| 167 | SP-132 | Pr-TF$r8AAWRLA$Q-NH2 | 1409.82 | 705.91 | 706.04 |
| 168 | SP-133 | Ac-QSQQTF%r8NLWRNleL%QN-NH2 | 2110.17 | 1056.09 | 1056.22 |
| 169 | SP-134 | Ac-LTF%r8HYWAQL%SA-NH2 | 1670.92 | 836.46 | 836.58 |
| 170 | SP-135 | Ac-NlePRF%r8NYWRLL%QN-NH2 | 1954.13 | 978.07 | 978.19 |
| 171 | SP-136 | Ac-NlePRF%r8NY6clWRLL%QN-NH2 | 1988.09 | 995.05 | 995.68 |
| 172 | SP-137 | Ac-LTF%r8HY6clWAQL%S-NH2 | 1633.84 | 817.92 | 817.93 |
| 173 | SP-138 | Ac-QS%QTF%StNLWRLL%s8QN-NH2 | 2149.24 | 1075.62 | 1075.65 |
| 174 | SP-139 | Ac-LTF%r8HY6clWRQL%S-NH2 | 1718.91 | 860.46 | 860.54 |
| 175 | SP-140 | Ac-QSQQTF%r8NL6clWRLL%QN-NH2 | 2144.13 | 1073.07 | 1073.64 |
| 176 | SP-141 | Ac-%r8SQQTFS%LWRLLAibQN-NH2 | 2040.15 | 1021.08 | 1021.13 |
| 177 | SP-142 | Ac-LTF%r8HYWAQL%S-NH2 | 1599.88 | 800.94 | 801.09 |
| 178 | SP-143 | Ac-TSF%r8QYWNLL%P-NH2 | 1602.88 | 802.44 | 802.58 |
| 179 | SP-147 | Ac-LTI-EHYWAQLTS-NH2 | 1535.74 | 768.87 | 769.5 |
| 180 | SP-152 | Ac-F$er8AY6clWEAc3cL$e-NH2 | 1277.63 | 639.82 | 1278.71 |
| 181 | SP-153 | Ac-AF$r8AAWALA$A-NH2 | 1277.63 | 639.82 | 1277.84 |
| 182 | SP-154 | Ac-TF$r8AAWRLA$Q-NH2 | 1395.80 | 698.90 | 699.04 |

TABLE 4-continued

| SEQ ID NO: | SP | Seq | Exact Mass | M + 2 | Observed mass (m/e) |
|---|---|---|---|---|---|
| 183 | SP-155 | Pr-TF$r8AAWRLA$Q-NH2 | 1409.82 | 705.91 | 706.04 |
| 184 | SP-156 | Ac-LTF$er8HYWAQL$eS-NH2 | 1597.87 | 799.94 | 800.44 |
| 185 | SP-159 | Ac-CCPGCCBaQSQQTF$r8NLWREL$QN-NH2 | 2745.30 | 1373.65 | 1372.99 |
| 186 | SP-160 | Ac-CCPGCCBaQSQQTA$r8NLWREL$QN-NH2 | 2669.27 | 1335.64 | 1336.09 |
| 187 | SP-161 | Ac-CCPGCCBaNlePRF$r8NYWREL$QN-NH2 | 2589.26 | 1295.63 | 1296.2 |
| 188 | SP-162 | Ac-LTF$/r8HYWAQL$/S-NH2 | 1625.90 | 813.95 | 814.18 |
| 189 | SP-163 | Ac-F%r8HY6clWRAc3cL%-NH2 | 1372.72 | 687.36 | 687.59 |
| 190 | SP-164 | Ac-QTF%r8HWWSQL%S-NH2 | 1653.87 | 827.94 | 827.94 |
| 191 | SP-165 | Ac-LTA$r8HYWRQL$S-NH2 | 1606.90 | 804.45 | 804.66 |
| 192 | SP-166 | Ac-Q$r8QQTFSN$WRLLAibQN-NH2 | 2080.12 | 1041.06 | 1041.61 |
| 193 | SP-167 | Ac-QSQQ$r8FSNLWR$LAibQN-NH2 | 2066.11 | 1034.06 | 1034.58 |
| 194 | SP-168 | Ac-F$r8AYWEAc3cL$A-NH2 | 1314.70 | 658.35 | 1315.88 |
| 195 | SP-169 | Ac-F$r8AYWEAc3cL$S-NH2 | 1330.70 | 666.35 | 1331.87 |
| 196 | SP-170 | Ac-F$r8AYWEAc3cL$Q-NH2 | 1371.72 | 686.86 | 1372.72 |
| 197 | SP-171 | Ac-F$r8AYWEAibL$S-NH2 | 1332.71 | 667.36 | 1334.83 |
| 198 | SP-172 | Ac-F$r8AYWEAL$S-NH2 | 1318.70 | 660.35 | 1319.73 |
| 199 | SP-173 | Ac-F$r8AYWEQL$S-NH2 | 1375.72 | 688.86 | 1377.53 |
| 200 | SP-174 | Ac-F$r8HYWEQL$S-NH2 | 1441.74 | 721.87 | 1443.48 |
| 201 | SP-175 | Ac-F$r8HYWAQL$S-NH2 | 1383.73 | 692.87 | 1385.38 |
| 202 | SP-176 | Ac-F$r8HYWAAc3cL$S-NH2 | 1338.71 | 670.36 | 1340.82 |
| 203 | SP-177 | Ac-F$r8HYWRAc3cL$S-NH2 | 1423.78 | 712.89 | 713.04 |
| 204 | SP-178 | Ac-F$r8AYWEAc3cL#A-NH2 | 1300.69 | 651.35 | 1302.78 |
| 205 | SP-179 | Ac-NlePTF%r8NYWREL%QN-NH2 | 1899.08 | 950.54 | 950.56 |
| 206 | SP-180 | Ac-TF$r8AAWRAL$Q-NH2 | 1395.80 | 698.90 | 699.13 |
| 207 | SP-181 | Ac-TSF%r8HYWAQL%S-NH2 | 1573.83 | 787.92 | 787.98 |
| 208 | SP-184 | Ac-F%r8AY6clWEAc3cL%A-NH2 | 1350.68 | 676.34 | 676.91 |
| 209 | SP-185 | Ac-LTF$r8HYWAQI$S-NH2 | 1597.87 | 799.94 | 800.07 |
| 210 | SP-186 | Ac-LTF$r8HYWAQNle$S-NH2 | 1597.87 | 799.94 | 800.07 |
| 211 | SP-187 | Ac-LTF$r8HYWAQL$A-NH2 | 1581.87 | 791.94 | 792.45 |
| 212 | SP-188 | Ac-LTF$r8HYWAQL$Abu-NH2 | 1595.89 | 798.95 | 799.03 |
| 213 | SP-189 | Ac-LTF$r8HYWAbuQL$S-NH2 | 1611.88 | 806.94 | 807.47 |
| 214 | SP-190 | Ac-LTF$er8AYWAQL$eS-NH2 | 1531.84 | 766.92 | 766.96 |
| 215 | SP-191 | Ac-LAF$r8HYWAQL$S-NH2 | 1567.86 | 784.93 | 785.49 |
| 216 | SP-192 | Ac-LAF$r8AYWAQL$S-NH2 | 1501.83 | 751.92 | 752.01 |
| 217 | SP-193 | Ac-LTF$er8AYWAQL$eA-NH2 | 1515.85 | 758.93 | 758.97 |
| 218 | SP-194 | Ac-LAF$r8AYWAQL$A-NH2 | 1485.84 | 743.92 | 744.05 |
| 219 | SP-195 | Ac-LTF$r8NLWANleL$Q-NH2 | 1550.92 | 776.46 | 776.61 |

TABLE 4-continued

| SEQ ID NO: | SP | Seq | Exact Mass | M + 2 | Observed mass (m/e) |
|---|---|---|---|---|---|
| 220 | SP-196 | Ac-LTF$r8NLWANleL$A-NH2 | 1493.90 | 747.95 | 1495.6 |
| 221 | SP-197 | Ac-LTF$r8ALWANleL$Q-NH2 | 1507.92 | 754.96 | 755 |
| 222 | SP-198 | Ac-LAF$r8NLWANleL$Q-NH2 | 1520.91 | 761.46 | 761.96 |
| 223 | SP-199 | Ac-LAF$r8ALWANleL$A-NH2 | 1420.89 | 711.45 | 1421.74 |
| 224 | SP-200 | Ac-A$r8AYWEAc3cL$A-NH2 | 1238.67 | 620.34 | 1239.65 |
| 225 | SP-201 | Ac-F$r8AYWEAc3cL$AA-NH2 | 1385.74 | 693.87 | 1386.64 |
| 226 | SP-202 | Ac-F$r8AYWEAc3cL$Abu-NH2 | 1328.72 | 665.36 | 1330.17 |
| 227 | SP-203 | Ac-F$r8AYWEAc3cL$Nle-NH2 | 1356.75 | 679.38 | 1358.22 |
| 228 | SP-204 | Ac-F$r5AYWEAc3cL$s8A-NH2 | 1314.70 | 658.35 | 1315.51 |
| 229 | SP-205 | Ac-F$AYWEAc3cL$r8A-NH2 | 1314.70 | 658.35 | 1315.66 |
| 230 | SP-206 | Ac-F$r8AYWEAc3cI$A-NH2 | 1314.70 | 658.35 | 1316.18 |
| 231 | SP-207 | Ac-F$r8AYWEAc3cNle$A-NH2 | 1314.70 | 658.35 | 1315.66 |
| 232 | SP-208 | Ac-F$r8AYWEAmlL$A-NH2 | 1358.76 | 680.38 | 1360.21 |
| 233 | SP-209 | Ac-F$r8AYWENleL$A-NH2 | 1344.75 | 673.38 | 1345.71 |
| 234 | SP-210 | Ac-F$r8AYWQAc3cL$A-NH2 | 1313.72 | 657.86 | 1314.7 |
| 235 | SP-211 | Ac-F$r8AYWAAc3cL$A-NH2 | 1256.70 | 629.35 | 1257.56 |
| 236 | SP-212 | Ac-F$r8AYWAbuAc3cL$A-NH2 | 1270.71 | 636.36 | 1272.14 |
| 237 | SP-213 | Ac-F$r8AYWNleAc3cL$A-NH2 | 1298.74 | 650.37 | 1299.67 |
| 238 | SP-214 | Ac-F$r8AbuYWEAc3cL$A-NH2 | 1328.72 | 665.36 | 1329.65 |
| 239 | SP-215 | Ac-F$r8NleYWEAc3cL$A-NH2 | 1356.75 | 679.38 | 1358.66 |
| 240 | SP-216 | 5-FAM-BaLTFEHYWAQLTS-NH2 | 1922.82 | 962.41 | 962.87 |
| 241 | SP-217 | 5-FAM-BaLTF%r8HYWAQL%S-NH2 | 1986.96 | 994.48 | 994.97 |
| 242 | SP-218 | Ac-LTF$r8HYWAQhL$S-NH2 | 1611.88 | 806.94 | 807 |
| 243 | SP-219 | Ac-LTF$r8HYWAQTle$S-NH2 | 1597.87 | 799.94 | 799.97 |
| 244 | SP-220 | Ac-LTF$r8HYWAQAdm$S-NH2 | 1675.91 | 838.96 | 839.09 |
| 245 | SP-221 | Ac-LTF$r8HYWAQhCha$S-NH2 | 1651.91 | 826.96 | 826.98 |
| 246 | SP-222 | Ac-LTF$r8HYWAQCha$S-NH2 | 1637.90 | 819.95 | 820.02 |
| 247 | SP-223 | Ac-LTF$r8HYWAc6cQL$S-NH2 | 1651.91 | 826.96 | 826.98 |
| 248 | SP-224 | Ac-LTF$r8HYWAc5cQL$S-NH2 | 1637.90 | 819.95 | 820.02 |
| 249 | SP-225 | Ac-LThF$r8HYWAQL$S-NH2 | 1611.88 | 806.94 | 807 |
| 250 | SP-226 | Ac-LTIgl$r8HYWAQL$S-NH2 | 1625.90 | 813.95 | 812.99 |
| 251 | SP-227 | Ac-LTF$r8HYWAQChg$S-NH2 | 1623.88 | 812.94 | 812.99 |
| 252 | SP-228 | Ac-LTF$r8HYWAQF$S-NH2 | 1631.85 | 816.93 | 816.99 |
| 253 | SP-229 | Ac-LTF$r8HYWAQIgl$S-NH2 | 1659.88 | 830.94 | 829.94 |
| 254 | SP-230 | Ac-LTF$r8HYWAQCba$S-NH2 | 1609.87 | 805.94 | 805.96 |
| 255 | SP-231 | Ac-LTF$r8HYWAQCpg$S-NH2 | 1609.87 | 805.94 | 805.96 |
| 256 | SP-232 | Ac-LTF$r8HhYWAQL$S-NH2 | 1611.88 | 806.94 | 807 |
| 257 | SP-233 | Ac-F$r8AYWEAc3chL$A-NH2 | 1328.72 | 665.36 | 665.43 |

TABLE 4-continued

| SEQ ID NO: | SP | Seq | Exact Mass | M + 2 | Observed mass (m/e) |
|---|---|---|---|---|---|
| 258 | SP-234 | Ac-F$r8AYWEAc3cTle$A-NH2 | 1314.70 | 658.35 | 1315.62 |
| 259 | SP-235 | Ac-F$r8AYWEAc3cAdm$A-NH2 | 1392.75 | 697.38 | 697.47 |
| 260 | SP-236 | Ac-F$r8AYWEAc3chCha$A-NH2 | 1368.75 | 685.38 | 685.34 |
| 261 | SP-237 | Ac-F$r8AYWEAc3cCha$A-NH2 | 1354.73 | 678.37 | 678.38 |
| 262 | SP-238 | Ac-F$r8AYWEAc6cL$A-NH2 | 1356.75 | 679.38 | 679.42 |
| 263 | SP-239 | Ac-F$r8AYWEAc5cL$A-NH2 | 1342.73 | 672.37 | 672.46 |
| 264 | SP-240 | Ac-hF$r8AYWEAc3cL$A-NH2 | 1328.72 | 665.36 | 665.43 |
| 265 | SP-241 | Ac-Igl$r8AYWEAc3cL$A-NH2 | 1342.73 | 672.37 | 671.5 |
| 266 | SP-243 | Ac-F$r8AYWEAc3cF$A-NH2 | 1348.69 | 675.35 | 675.35 |
| 267 | SP-244 | Ac-F$r8AYWEAc3cIgl$A-NH2 | 1376.72 | 689.36 | 688.37 |
| 268 | SP-245 | Ac-F$r8AYWEAc3cCba$A-NH2 | 1326.70 | 664.35 | 664.47 |
| 269 | SP-246 | Ac-F$r8AYWEAc3cCpg$A-NH2 | 1326.70 | 664.35 | 664.39 |
| 270 | SP-247 | Ac-F$r8AhYWEAc3cL$A-NH2 | 1328.72 | 665.36 | 665.43 |
| 271 | SP-248 | Ac-F$r8AYWEAc3cL$Q-NH2 | 1371.72 | 686.86 | 1372.87 |
| 272 | SP-249 | Ac-F$r8AYWEAibL$A-NH2 | 1316.72 | 659.36 | 1318.18 |
| 273 | SP-250 | Ac-F$r8AYWEAL$A-NH2 | 1302.70 | 652.35 | 1303.75 |
| 274 | SP-251 | Ac-LAF$r8AYWAAL$A-NH2 | 1428.82 | 715.41 | 715.49 |
| 275 | SP-252 | Ac-LTF$r8HYWAAc3cL$S-NH2 | 1552.84 | 777.42 | 777.5 |
| 276 | SP-253 | Ac-NleTF$r8HYWAQL$S-NH2 | 1597.87 | 799.94 | 800.04 |
| 277 | SP-254 | Ac-VTF$r8HYWAQL$S-NH2 | 1583.85 | 792.93 | 793.04 |
| 278 | SP-255 | Ac-FTF$r8HYWAQL$S-NH2 | 1631.85 | 816.93 | 817.02 |
| 279 | SP-256 | Ac-WTF$r8HYWAQL$S-NH2 | 1670.86 | 836.43 | 836.85 |
| 280 | SP-257 | Ac-RTF$r8HYWAQL$S-NH2 | 1640.88 | 821.44 | 821.9 |
| 281 | SP-258 | Ac-KTF$r8HYWAQL$S-NH2 | 1612.88 | 807.44 | 807.91 |
| 282 | SP-259 | Ac-LNleF$r8HYWAQL$S-NH2 | 1609.90 | 805.95 | 806.43 |
| 283 | SP-260 | Ac-LVF$r8HYWAQL$S-NH2 | 1595.89 | 798.95 | 798.93 |
| 284 | SP-261 | Ac-LFF$r8HYWAQL$S-NH2 | 1643.89 | 822.95 | 823.38 |
| 285 | SP-262 | Ac-LWF$r8HYWAQL$S-NH2 | 1682.90 | 842.45 | 842.55 |
| 286 | SP-263 | Ac-LRF$r8HYWAQL$S-NH2 | 1652.92 | 827.46 | 827.52 |
| 287 | SP-264 | Ac-LKF$r8HYWAQL$S-NH2 | 1624.91 | 813.46 | 813.51 |
| 288 | SP-265 | Ac-LTF$r8NleYWAQL$S-NH2 | 1573.89 | 787.95 | 788.05 |
| 289 | SP-266 | Ac-LTF$r8VYWAQL$S-NH2 | 1559.88 | 780.94 | 780.98 |
| 290 | SP-267 | Ac-LTF$r8FYWAQL$S-NH2 | 1607.88 | 804.94 | 805.32 |
| 291 | SP-268 | Ac-LTF$r8WYWAQL$S-NH2 | 1646.89 | 824.45 | 824.86 |
| 292 | SP-269 | Ac-LTF$r8RYWAQL$S-NH2 | 1616.91 | 809.46 | 809.51 |
| 293 | SP-270 | Ac-LTF$r8KYWAQL$S-NH2 | 1588.90 | 795.45 | 795.48 |
| 294 | SP-271 | Ac-LTF$r8HNleWAQL$S-NH2 | 1547.89 | 774.95 | 774.98 |
| 295 | SP-272 | Ac-LTF$r8HVWAQL$S-NH2 | 1533.87 | 767.94 | 767.95 |
| 296 | SP-273 | Ac-LTF$r8HFWAQL$S-NH2 | 1581.87 | 791.94 | 792.3 |

TABLE 4-continued

| SEQ ID NO: | SP | Seq | Exact Mass | M + 2 | Observed mass (m/e) |
|---|---|---|---|---|---|
| 297 | SP-274 | Ac-LTF$r8HWWAQL$S-NH2 | 1620.88 | 811.44 | 811.54 |
| 298 | SP-275 | Ac-LTF$r8HRWAQL$S-NH2 | 1590.90 | 796.45 | 796.52 |
| 299 | SP-276 | Ac-LTF$r8HKWAQL$S-NH2 | 1562.90 | 782.45 | 782.53 |
| 300 | SP-277 | Ac-LTF$r8HYWNleQL$S-NH2 | 1639.91 | 820.96 | 820.98 |
| 301 | SP-278 | Ac-LTF$r8HYWVQL$S-NH2 | 1625.90 | 813.95 | 814.03 |
| 302 | SP-279 | Ac-LTF$r8HYWFQL$S-NH2 | 1673.90 | 837.95 | 838.03 |
| 303 | SP-280 | Ac-LTF$r8HYWWQL$S-NH2 | 1712.91 | 857.46 | 857.5 |
| 304 | SP-281 | Ac-LTF$r8HYWKQL$S-NH2 | 1654.92 | 828.46 | 828.49 |
| 305 | SP-282 | Ac-LTF$r8HYWANleL$S-NH2 | 1582.89 | 792.45 | 792.52 |
| 306 | SP-283 | Ac-LTF$r8HYWAVL$S-NH2 | 1568.88 | 785.44 | 785.49 |
| 307 | SP-284 | Ac-LTF$r8HYWAFL$S-NH2 | 1616.88 | 809.44 | 809.47 |
| 308 | SP-285 | Ac-LTF$r8HYWAWL$S-NH2 | 1655.89 | 828.95 | 829 |
| 309 | SP-286 | Ac-LTF$r8HYWARL$S-NH2 | 1625.91 | 813.96 | 813.98 |
| 310 | SP-287 | Ac-LTF$r8HYWAQL$Nle-NH2 | 1623.92 | 812.96 | 813.39 |
| 311 | SP-288 | Ac-LTF$r8HYWAQL$V-NH2 | 1609.90 | 805.95 | 805.99 |
| 312 | SP-289 | Ac-LTF$r8HYWAQL$F-NH2 | 1657.90 | 829.95 | 830.26 |
| 313 | SP-290 | Ac-LTF$r8HYWAQL$W-NH2 | 1696.91 | 849.46 | 849.5 |
| 314 | SP-291 | Ac-LTF$r8HYWAQL$R-NH2 | 1666.94 | 834.47 | 834.56 |
| 315 | SP-292 | Ac-LTF$r8HYWAQL$K-NH2 | 1638.93 | 820.47 | 820.49 |
| 316 | SP-293 | Ac-Q$r8QQTFSN$WRLLAibQN-NH2 | 2080.12 | 1041.06 | 1041.54 |
| 317 | SP-294 | Ac-QSQQ$r8FSNLWR$LAibQN-NH2 | 2066.11 | 1034.06 | 1034.58 |
| 318 | SP-295 | Ac-LT2Pal$r8HYWAQL$S-NH2 | 1598.86 | 800.43 | 800.49 |
| 319 | SP-296 | Ac-LT3Pal$r8HYWAQL$S-NH2 | 1598.86 | 800.43 | 800.49 |
| 320 | SP-297 | Ac-LT4Pal$r8HYWAQL$S-NH2 | 1598.86 | 800.43 | 800.49 |
| 321 | SP-298 | Ac-LTF2CF3$r8HYWAQL$S-NH2 | 1665.85 | 833.93 | 834.01 |
| 322 | SP-299 | Ac-LTF2CN$r8HYWAQL$S-NH2 | 1622.86 | 812.43 | 812.47 |
| 323 | SP-300 | Ac-LTF2Me$r8HYWAQL$S-NH2 | 1611.88 | 806.94 | 807 |
| 324 | SP-301 | Ac-LTF3CL$r8HYWAQL$S-NH2 | 1631.83 | 816.92 | 816.99 |
| 325 | SP-302 | Ac-LTF4CF3$r8HYWAQL$S-NH2 | 1665.85 | 833.93 | 833.94 |
| 326 | SP-303 | Ac-LTF4tBu$r8HYWAQL$S-NH2 | 1653.93 | 827.97 | 828.02 |
| 327 | SP-304 | Ac-LTF5F$r8HYWAQL$S-NH2 | 1687.82 | 844.91 | 844.96 |
| 328 | SP-305 | Ac-LTF$r8HY3BthAAQL$S-NH2 | 1614.83 | 808.42 | 808.48 |
| 329 | SP-306 | Ac-LTF2Br$r8HYWAQL$S-NH2 | 1675.78 | 838.89 | 838.97 |
| 330 | SP-307 | Ac-LTF4Br$r8HYWAQL$S-NH2 | 1675.78 | 838.89 | 839.86 |
| 331 | SP-308 | Ac-LTF2CL$r8HYWAQL$S-NH2 | 1631.83 | 816.92 | 816.99 |
| 332 | SP-309 | Ac-LTF4CL$r8HYWAQL$S-NH2 | 1631.83 | 816.92 | 817.36 |
| 333 | SP-310 | Ac-LTF3CN$r8HYWAQL$S-NH2 | 1622.86 | 812.43 | 812.47 |
| 334 | SP-311 | Ac-LTF4CN$r8HYWAQL$S-NH2 | 1622.86 | 812.43 | 812.47 |

TABLE 4-continued

| SEQ ID NO: | SP | Seq | Exact Mass | M + 2 | Observed mass (m/e) |
|---|---|---|---|---|---|
| 335 | SP-312 | Ac-LTF34CL2$r8HYWAQL$S-NH2 | 1665.79 | 833.90 | 833.94 |
| 336 | SP-313 | Ac-LTF34F2Sr8HYWAQL$S-NH2 | 1633.85 | 817.93 | 817.95 |
| 337 | SP-314 | Ac-LTF35F2$r8HYWAQL$S-NH2 | 1633.85 | 817.93 | 817.95 |
| 338 | SP-315 | Ac-LTDip$r8HYWAQL$S-NH2 | 1673.90 | 837.95 | 838.01 |
| 339 | SP-316 | Ac-LTF2F$r8HYWAQL$S-NH2 | 1615.86 | 808.93 | 809 |
| 340 | SP-317 | Ac-LTF3F$r8HYWAQL$S-NH2 | 1615.86 | 808.93 | 809 |
| 341 | SP-318 | Ac-LTF4F$r8HYWAQL$S-NH2 | 1615.86 | 808.93 | 809 |
| 342 | SP-319 | Ac-LTF4M8HYWAQL$S-NH2 | 1723.76 | 862.88 | 862.94 |
| 343 | SP-320 | Ac-LTF3Me$r8HYWAQL$S-NH2 | 1611.88 | 806.94 | 807.07 |
| 344 | SP-321 | Ac-LTF4Me$r8HYWAQL$S-NH2 | 1611.88 | 806.94 | 807 |
| 345 | SP-322 | Ac-LT1Nal$r8HYWAQL$S-NH2 | 1647.88 | 824.94 | 824.98 |
| 346 | SP-323 | Ac-LT2Nal$r8HYWAQL$S-NH2 | 1647.88 | 824.94 | 825.06 |
| 347 | SP-324 | Ac-LTF3CF3$r8HYWAQL$S-NH2 | 1665.85 | 833.93 | 834.01 |
| 348 | SP-325 | Ac-LTF4NQ2$r8HYWAQL$S-NH2 | 1642.85 | 822.43 | 822.46 |
| 349 | SP-326 | Ac-LTF3NQ2$r8HYWAQL$S-NH2 | 1642.85 | 822.43 | 822.46 |
| 350 | SP-327 | Ac-LTF$r82ThiYWAQL$S-NH2 | 1613.83 | 807.92 | 807.96 |
| 351 | SP-328 | Ac-LTF$r8HBipWAQL$S-NH2 | 1657.90 | 829.95 | 830.01 |
| 352 | SP-329 | Ac-LTF$r8HF4tBuWAQL$S-NH2 | 1637.93 | 819.97 | 820.02 |
| 353 | SP-330 | Ac-LTF$r8HF4CF3WAQL$S-NH2 | 1649.86 | 825.93 | 826.02 |
| 354 | SP-331 | Ac-LTF$r8HF4CLWAQL$S-NH2 | 1615.83 | 808.92 | 809.37 |
| 355 | SP-332 | Ac-LTF$r8HF4MeWAQL$S-NH2 | 1595.89 | 798.95 | 799.01 |
| 356 | SP-333 | Ac-LTF$r8HF4BrWAQL$S-NH2 | 1659.78 | 830.89 | 830.98 |
| 357 | SP-334 | Ac-LTF$r8HF4CNWAQL$S-NH2 | 1606.87 | 804.44 | 804.56 |
| 358 | SP-335 | Ac-LTF$r8HF4NQ2WAQL$S-NH2 | 1626.86 | 814.43 | 814.55 |
| 359 | SP-336 | Ac-LTF$r8H1NalWAQL$S-NH2 | 1631.89 | 816.95 | 817.06 |
| 360 | SP-337 | Ac-LTF$r8H2NalWAQL$S-NH2 | 1631.89 | 816.95 | 816.99 |
| 361 | SP-338 | Ac-LTF$r8HWAQL$S-NH2 | 1434.80 | 718.40 | 718.49 |
| 362 | SP-339 | Ac-LTF$r8HY1NalAQL$S-NH2 | 1608.87 | 805.44 | 805.52 |
| 363 | SP-340 | Ac-LTF$r8HY2NalAQL$S-NH2 | 1608.87 | 805.44 | 805.52 |
| 364 | SP-341 | Ac-LTF$r8HYWAQ1$S-NH2 | 1597.87 | 799.94 | 800.07 |
| 365 | SP-342 | Ac-LTF$r8HYWAQNle$S-NH2 | 1597.87 | 799.94 | 800.44 |
| 366 | SP-343 | Ac-LTF$er8HYWAQL$eA-NH2 | 1581.87 | 791.94 | 791.98 |
| 367 | SP-344 | Ac-LTF$r8HYWAQL$Abu-NH2 | 1595.89 | 798.95 | 799.03 |
| 368 | SP-345 | Ac-LTF$r8HYWAbuQL$S-NH2 | 1611.88 | 806.94 | 804.47 |
| 369 | SP-346 | Ac-LAF$r8HYWAQL$S-NH2 | 1567.86 | 784.93 | 785.49 |
| 370 | SP-347 | Ac-LTF$r8NLWANleL$Q-NH2 | 1550.92 | 776.46 | 777.5 |
| 371 | SP-348 | Ac-LTF$r8ALWANleL$Q-NH2 | 1507.92 | 754.96 | 755.52 |
| 372 | SP-349 | Ac-LAF$r8NLWANleL$Q-NH2 | 1520.91 | 761.46 | 762.48 |
| 373 | SP-350 | Ac-F$r8AYWAAc3cL$A-NH2 | 1256.70 | 629.35 | 1257.56 |

TABLE 4-continued

| SEQ ID NO: | SP | Seq | Exact Mass | M + 2 | Observed mass (m/e) |
|---|---|---|---|---|---|
| 374 | SP-351 | Ac-LTF$r8AYWAAL$S-NH2 | 1474.82 | 738.41 | 738.55 |
| 375 | SP-352 | Ac-LVF$r8AYWAQL$S-NH2 | 1529.87 | 765.94 | 766 |
| 376 | SP-353 | Ac-LTF$r8AYWAbuQL$S-NH2 | 1545.86 | 773.93 | 773.92 |
| 377 | SP-354 | Ac-LTF$r8AYWNleQL$S-NH2 | 1573.89 | 787.95 | 788.17 |
| 378 | SP-355 | Ac-LTF$r8AbuYWAQL$S-NH2 | 1545.86 | 773.93 | 773.99 |
| 379 | SP-356 | Ac-LTF$r8AYWHQL$S-NH2 | 1597.87 | 799.94 | 799.97 |
| 380 | SP-357 | Ac-LTF$r8AYWKQL$S-NH2 | 1588.90 | 795.45 | 795.53 |
| 381 | SP-358 | Ac-LTF$r8AYWQQL$S-NH2 | 1574.89 | 788.45 | 788.5 |
| 382 | SP-359 | Ac-LTF$r8AYWRQL$S-NH2 | 1616.91 | 809.46 | 809.51 |
| 383 | SP-360 | Ac-LTF$r8AYWSQL$S-NH2 | 1547.84 | 774.92 | 774.96 |
| 384 | SP-361 | Ac-LTF$r8AYWRAL$S-NH2 | 1559.89 | 780.95 | 780.95 |
| 385 | SP-362 | Ac-LTF$r8AYWRQL$A-NH2 | 1600.91 | 801.46 | 801.52 |
| 386 | SP-363 | Ac-LTF$r8AYWRAL$A-NH2 | 1543.89 | 772.95 | 773.03 |
| 387 | SP-364 | Ac-LTF$r5HYWAQL$s8S-NH2 | 1597.87 | 799.94 | 799.97 |
| 388 | SP-365 | Ac-LTF$HYWAQL$r8S-NH2 | 1597.87 | 799.94 | 799.97 |
| 389 | SP-366 | Ac-LTF$r8HYWAAL$S-NH2 | 1540.84 | 771.42 | 771.48 |
| 390 | SP-367 | Ac-LTF$r8HYWAAbuL$S-NH2 | 1554.86 | 778.43 | 778.51 |
| 391 | SP-368 | Ac-LTF$r8HYWALL$S-NH2 | 1582.89 | 792.45 | 792.49 |
| 392 | SP-369 | Ac-F$r8AYWHAL$A-NH2 | 1310.72 | 656.36 | 656.4 |
| 393 | SP-370 | Ac-F$r8AYWAAL$A-NH2 | 1244.70 | 623.35 | 1245.61 |
| 394 | SP-371 | Ac-F$r8AYWSAL$A-NH2 | 1260.69 | 631.35 | 1261.6 |
| 395 | SP-372 | Ac-F$r8AYWRAL$A-NH2 | 1329.76 | 665.88 | 1330.72 |
| 396 | SP-373 | Ac-F$r8AYWKAL$A-NH2 | 1301.75 | 651.88 | 1302.67 |
| 397 | SP-374 | Ac-F$r8AYWQAL$A-NH2 | 1287.74 | 644.87 | 1289.13 |
| 398 | SP-375 | Ac-F$r8VYWEAc3cL$A-NH2 | 1342.73 | 672.37 | 1343.67 |
| 399 | SP-376 | Ac-F$r8FYWEAc3cL$A-NH2 | 1390.73 | 696.37 | 1392.14 |
| 400 | SP-377 | Ac-F$r8WYWEAc3cL$A-NH2 | 1429.74 | 715.87 | 1431.44 |
| 401 | SP-378 | Ac-F$r8RYWEAc3cL$A-NH2 | 1399.77 | 700.89 | 700.95 |
| 402 | SP-379 | Ac-F$r8KYWEAc3cL$A-NH2 | 1371.76 | 686.88 | 686.97 |
| 403 | SP-380 | Ac-F$r8ANleWEAc3cL$A-NH2 | 1264.72 | 633.36 | 1265.59 |
| 404 | SP-381 | Ac-F$r8AVWEAc3cL$A-NH2 | 1250.71 | 626.36 | 1252.2 |
| 405 | SP-382 | Ac-F$r8AFWEAc3cL$A-NH2 | 1298.71 | 650.36 | 1299.64 |
| 406 | SP-383 | Ac-F$r8AWWEAc3cL$A-NH2 | 1337.72 | 669.86 | 1338.64 |
| 407 | SP-384 | Ac-F$r8ARWEAc3cL$A-NH2 | 1307.74 | 654.87 | 655 |
| 408 | SP-385 | Ac-F$r8AKWEAc3cL$A-NH2 | 1279.73 | 640.87 | 641.01 |
| 409 | SP-386 | Ac-F$r8AYWVAc3cL$A-NH2 | 1284.73 | 643.37 | 643.38 |
| 410 | SP-387 | Ac-F$r8AYWFAc3cL$A-NH2 | 1332.73 | 667.37 | 667.43 |
| 411 | SP-388 | Ac-F$r8AYWWAc3cL$A-NH2 | 1371.74 | 686.87 | 686.97 |

TABLE 4-continued

| SEQ ID NO: | SP | Seq | Exact Mass | M + 2 | Observed mass (m/e) |
|---|---|---|---|---|---|
| 412 | SP-389 | Ac-F$r8AYWRAc3cL$A-NH2 | 1341.76 | 671.88 | 671.94 |
| 413 | SP-390 | Ac-F$r8AYWKAc3cL$A-NH2 | 1313.75 | 657.88 | 657.88 |
| 414 | SP-391 | Ac-F$r8AYWEVL$A-NH2 | 1330.73 | 666.37 | 666.47 |
| 415 | SP-392 | Ac-F$r8AYWEFL$A-NH2 | 1378.73 | 690.37 | 690.44 |
| 416 | SP-393 | Ac-F$r8AYWEWL$A-NH2 | 1417.74 | 709.87 | 709.91 |
| 417 | SP-394 | Ac-F$r8AYWERL$A-NH2 | 1387.77 | 694.89 | 1388.66 |
| 418 | SP-395 | Ac-F$r8AYWEKL$A-NH2 | 1359.76 | 680.88 | 1361.21 |
| 419 | SP-396 | Ac-F$r8AYWEAc3cL$V-NH2 | 1342.73 | 672.37 | 1343.59 |
| 420 | SP-397 | Ac-F$r8AYWEAc3cL$F-NH2 | 1390.73 | 696.37 | 1392.58 |
| 421 | SP-398 | Ac-F$r8AYWEAc3cL$W-NH2 | 1429.74 | 715.87 | 1431.29 |
| 422 | SP-399 | Ac-F$r8AYWEAc3cL$R-NH2 | 1399.77 | 700.89 | 700.95 |
| 423 | SP-400 | Ac-F$r8AYWEAc3cL$K-NH2 | 1371.76 | 686.88 | 686.97 |
| 424 | SP-401 | Ac-F$r8AYWEAc3cL$AV-NH2 | 1413.77 | 707.89 | 707.91 |
| 425 | SP-402 | Ac-F$r8AYWEAc3cL$AF-NH2 | 1461.77 | 731.89 | 731.96 |
| 426 | SP-403 | Ac-F$r8AYWEAc3cL$AW-NH2 | 1500.78 | 751.39 | 751.5 |
| 427 | SP-404 | Ac-F$r8AYWEAc3cL$AR-NH2 | 1470.80 | 736.40 | 736.47 |
| 428 | SP-405 | Ac-F$r8AYWEAc3cL$AK-NH2 | 1442.80 | 722.40 | 722.41 |
| 429 | SP-406 | Ac-F$r8AYWEAc3cL$AH-NH2 | 1451.76 | 726.88 | 726.93 |
| 430 | SP-407 | Ac-LTF2NQ2$r8HYWAQL$S-NH2 | 1642.85 | 822.43 | 822.54 |
| 431 | SP-408 | Ac-LTA$r8HYAAQL$S-NH2 | 1406.79 | 704.40 | 704.5 |
| 432 | SP-409 | Ac-LTF$r8HYAAQL$S-NH2 | 1482.82 | 742.41 | 742.47 |
| 433 | SP-410 | Ac-QSQQTF$r8NLWALL$AN-NH2 | 1966.07 | 984.04 | 984.38 |
| 434 | SP-411 | Ac-QAibQQTF$r8NLWALL$AN-NH2 | 1964.09 | 983.05 | 983.42 |
| 435 | SP-412 | Ac-QAibQQTF$r8ALWALL$AN-NH2 | 1921.08 | 961.54 | 961.59 |
| 436 | SP-413 | Ac-AAAATF$r8AAWAAL$AA-NH2 | 1608.90 | 805.45 | 805.52 |
| 437 | SP-414 | Ac-F$r8AAWRAL$Q-NH2 | 1294.76 | 648.38 | 648.48 |
| 438 | SP-415 | Ac-TF$r8AAWAAL$Q-NH2 | 1310.74 | 656.37 | 1311.62 |
| 439 | SP-416 | Ac-TF$r8AAWRAL$A-NH2 | 1338.78 | 670.39 | 670.46 |
| 440 | SP-417 | Ac-VF$r8AAWRAL$Q-NH2 | 1393.82 | 697.91 | 697.99 |
| 441 | SP-418 | Ac-AF$r8AAWAAL$A-NH2 | 1223.71 | 612.86 | 1224.67 |
| 442 | SP-420 | Ac-TF$r8AAWKAL$Q-NH2 | 1367.80 | 684.90 | 684.97 |
| 443 | SP-421 | Ac-TF$r8AAWQAL$Q-NH2 | 1353.78 | 677.89 | 678.01 |
| 444 | SP-422 | Ac-TF$r8AAWSAL$Q-NH2 | 1326.73 | 664.37 | 664.47 |
| 445 | SP-423 | Ac-LTF$r8AAWRAL$Q-NH2 | 1508.89 | 755.45 | 755.49 |
| 446 | SP-424 | Ac-F$r8AYWAQL$A-NH2 | 1301.72 | 651.86 | 651.96 |
| 447 | SP-425 | Ac-F$r8AWWAAL$A-NH2 | 1267.71 | 634.86 | 634.87 |
| 448 | SP-426 | Ac-F$r8AWWAQL$A-NH2 | 1324.73 | 663.37 | 663.43 |
| 449 | SP-427 | Ac-F$r8AYWEAL$-NH2 | 1231.66 | 616.83 | 1232.93 |
| 450 | SP-428 | Ac-F$r8AYWAAL$-NH2 | 1173.66 | 587.83 | 1175.09 |

TABLE 4-continued

| SEQ ID NO: | SP | Seq | Exact Mass | M + 2 | Observed mass (m/e) |
|---|---|---|---|---|---|
| 451 | SP-429 | Ac-F$r8AYWKAL$-NH2 | 1230.72 | 616.36 | 616.44 |
| 452 | SP-430 | Ac-F$r8AYWQAL$-NH2 | 1216.70 | 609.35 | 609.48 |
| 453 | SP-431 | Ac-F$r8AYWQAL$-NH2 | 1230.68 | 616.34 | 616.44 |
| 454 | SP-432 | Ac-F$r8AYWAQL$-NH2 | 1230.68 | 616.34 | 616.37 |
| 455 | SP-433 | Ac-F$r8HYWDQL$S-NH2 | 1427.72 | 714.86 | 714.86 |
| 456 | SP-434 | Ac-F$r8HFWEQL$S-NH2 | 1425.74 | 713.87 | 713.98 |
| 457 | SP-435 | Ac-F$r8AYWHQL$S-NH2 | 1383.73 | 692.87 | 692.96 |
| 458 | SP-436 | Ac-F$r8AYWKQL$S-NH2 | 1374.77 | 688.39 | 688.45 |
| 459 | SP-437 | Ac-F$r8AYWQQL$S-NH2 | 1360.75 | 681.38 | 681.49 |
| 460 | SP-438 | Ac-F$r8HYWSQL$S-NH2 | 1399.73 | 700.87 | 700.95 |
| 461 | SP-439 | Ac-F$r8HWWEQL$S-NH2 | 1464.76 | 733.38 | 733.44 |
| 462 | SP-440 | Ac-F$r8HWWAQL$S-NH2 | 1406.75 | 704.38 | 704.43 |
| 463 | SP-441 | Ac-F$r8AWWHQL$S-NH2 | 1406.75 | 704.38 | 704.43 |
| 464 | SP-442 | Ac-F$r8AWWKQL$S-NH2 | 1397.79 | 699.90 | 699.92 |
| 465 | SP-443 | Ac-F$r8AWWQQL$S-NH2 | 1383.77 | 692.89 | 692.96 |
| 466 | SP-444 | Ac-F$r8HWWSQL$S-NH2 | 1422.75 | 712.38 | 712.42 |
| 467 | SP-445 | Ac-LTF$r8NYWAN1eL$Q-NH2 | 1600.90 | 801.45 | 801.52 |
| 468 | SP-446 | Ac-LTF$r8NLWAQL$Q-NH2 | 1565.90 | 783.95 | 784.06 |
| 469 | SP-447 | Ac-LTF$r8NYWAN1eL$A-NH2 | 1543.88 | 772.94 | 773.03 |
| 470 | SP-448 | Ac-LTF$r8NLWAQL$A-NH2 | 1508.88 | 755.44 | 755.49 |
| 471 | SP-449 | Ac-LTF$r8AYWAN1eL$Q-NH2 | 1557.90 | 779.95 | 780.06 |
| 472 | SP-450 | Ac-LTF$r8ALWAQL$Q-NH2 | 1522.89 | 762.45 | 762.45 |
| 473 | SP-451 | Ac-LAF$r8NYWAN1eL$Q-NH2 | 1570.89 | 786.45 | 786.5 |
| 474 | SP-452 | Ac-LAF$r8NLWAQL$Q-NH2 | 1535.89 | 768.95 | 769.03 |
| 475 | SP-453 | Ac-LAF$r8AYWAN1eL$A-NH2 | 1470.86 | 736.43 | 736.47 |
| 476 | SP-454 | Ac-LAF$r8ALWAQL$A-NH2 | 1435.86 | 718.93 | 719.01 |
| 477 | SP-455 | Ac-LAF$r8AYWAAL$A-NH2 | 1428.82 | 715.41 | 715.41 |
| 478 | SP-456 | Ac-F$r8AYWEAc3cL$AAib-NH2 | 1399.75 | 700.88 | 700.95 |
| 479 | SP-457 | Ac-F$r8AYWAQL$AA-NH2 | 1372.75 | 687.38 | 687.78 |
| 480 | SP-458 | Ac-F$r8AYWAAc3cL$AA-NH2 | 1327.73 | 664.87 | 664.84 |
| 481 | SP-459 | Ac-F$r8AYWSAc3cL$AA-NH2 | 1343.73 | 672.87 | 672.9 |
| 482 | SP-460 | Ac-F$r8AYWEAc3cL$AS-NH2 | 1401.73 | 701.87 | 701.84 |
| 483 | SP-461 | Ac-F$r8AYWEAc3cL$AT-NH2 | 1415.75 | 708.88 | 708.87 |
| 484 | SP-462 | Ac-F$r8AYWEAc3cL$AL-NH2 | 1427.79 | 714.90 | 714.94 |
| 485 | SP-463 | Ac-F$r8AYWEAc3cL$AQ-NH2 | 1442.76 | 722.38 | 722.41 |
| 486 | SP-464 | Ac-F$r8AFWEAc3cL$AA-NH2 | 1369.74 | 685.87 | 685.93 |
| 487 | SP-465 | Ac-F$r8AWWEAc3cL$AA-NH2 | 1408.75 | 705.38 | 705.39 |
| 488 | SP-466 | Ac-F$r8AYWEAc3cL$SA-NH2 | 1401.73 | 701.87 | 701.99 |

TABLE 4-continued

| SEQ ID NO: | SP | Seq | Exact Mass | M + 2 | Observed mass (m/e) |
|---|---|---|---|---|---|
| 489 | SP-467 | Ac-F$r8AYWEAL$AA-NH2 | 1373.74 | 687.87 | 687.93 |
| 490 | SP-468 | Ac-F$r8AYWENleL$AA-NH2 | 1415.79 | 708.90 | 708.94 |
| 491 | SP-469 | Ac-F$r8AYWEAc3cL$AbuA-NH2 | 1399.75 | 700.88 | 700.95 |
| 492 | SP-470 | Ac-F$r8AYWEAc3cL$NleA-NH2 | 1427.79 | 714.90 | 714.86 |
| 493 | SP-471 | Ac-F$r8AYWEAibL$NleA-NH2 | 1429.80 | 715.90 | 715.97 |
| 494 | SP-472 | Ac-F$r8AYWEAL$NleA-NH2 | 1415.79 | 708.90 | 708.94 |
| 495 | SP-473 | Ac-F$r8AYWENleL$NleA-NH2 | 1457.83 | 729.92 | 729.96 |
| 496 | SP-474 | Ac-F$r8AYWEAibL$Abu-NH2 | 1330.73 | 666.37 | 666.39 |
| 497 | SP-475 | Ac-F$r8AYWENleL$Abu-NH2 | 1358.76 | 680.38 | 680.39 |
| 498 | SP-476 | Ac-F$r8AYWEAL$Abu-NH2 | 1316.72 | 659.36 | 659.36 |
| 499 | SP-477 | Ac-LTF$r8AFWAQL$S-NH2 | 1515.85 | 758.93 | 759.12 |
| 500 | SP-478 | Ac-LTF$r8AWWAQL$S-NH2 | 1554.86 | 778.43 | 778.51 |
| 501 | SP-479 | Ac-LTF$r8AYWAQI$S-NH2 | 1531.84 | 766.92 | 766.96 |
| 502 | SP-480 | Ac-LTF$r8AYWAQNle$S-NH2 | 1531.84 | 766.92 | 766.96 |
| 503 | SP-481 | Ac-LTF$r8AYWAQL$SA-NH2 | 1602.88 | 802.44 | 802.48 |
| 504 | SP-482 | Ac-LTF$r8AWWAQL$A-NH2 | 1538.87 | 770.44 | 770.89 |
| 505 | SP-483 | Ac-LTF$r8AYWAQI$A-NH2 | 1515.85 | 758.93 | 759.42 |
| 506 | SP-484 | Ac-LTF$r8AYWAQNle$A-NH2 | 1515.85 | 758.93 | 759.42 |
| 507 | SP-485 | Ac-LTF$r8AYWAQL$AA-NH2 | 1586.89 | 794.45 | 794.94 |
| 508 | SP-486 | Ac-LTF$r8HWWAQL$S-NH2 | 1620.88 | 811.44 | 811.47 |
| 509 | SP-487 | Ac-LTF$r8HRWAQL$S-NH2 | 1590.90 | 796.45 | 796.52 |
| 510 | SP-488 | Ac-LTF$r8HKWAQL$S-NH2 | 1562.90 | 782.45 | 782.53 |
| 511 | SP-489 | Ac-LTF$r8HYWAQL$W-NH2 | 1696.91 | 849.46 | 849.5 |
| 512 | SP-491 | Ac-F$r8AYWAbuAL$A-NH2 | 1258.71 | 630.36 | 630.5 |
| 513 | SP-492 | Ac-F$r8AbuYWEAL$A-NH2 | 1316.72 | 659.36 | 659.51 |
| 514 | SP-493 | Ac-NlePRF%r8NYWRLL%QN-NH2 | 1954.13 | 978.07 | 978.54 |
| 515 | SP-494 | Ac-TSF%r8HYWAQL%S-NH2 | 1573.83 | 787.92 | 787.98 |
| 516 | SP-495 | Ac-LTF%r8AYWAQL%S-NH2 | 1533.86 | 767.93 | 768 |
| 517 | SP-496 | Ac-HTF$r8HYWAQL$S-NH2 | 1621.84 | 811.92 | 811.96 |
| 518 | SP-497 | Ac-LHF$r8HYWAQL$S-NH2 | 1633.88 | 817.94 | 818.02 |
| 519 | SP-498 | Ac-LTF$r8HHWAQL$S-NH2 | 1571.86 | 786.93 | 786.94 |
| 520 | SP-499 | Ac-LTF$r8HYWHQL$S-NH2 | 1663.89 | 832.95 | 832.38 |
| 521 | SP-500 | Ac-LTF$r8HYWAHL$S-NH2 | 1606.87 | 804.44 | 804.48 |
| 522 | SP-501 | Ac-LTF$r8HYWAQL$H-NH2 | 1647.89 | 824.95 | 824.98 |
| 523 | SP-502 | Ac-LTF$r8HYWAQL$S-NHPr | 1639.91 | 820.96 | 820.98 |
| 524 | SP-503 | Ac-LTF$r8HYWAQL$S-NHsBu | 1653.93 | 827.97 | 828.02 |
| 525 | SP-504 | Ac-LTF$r8HYWAQL$S-NHiBu | 1653.93 | 827.97 | 828.02 |
| 526 | SP-505 | Ac-LTF$r8HYWAQL$S-NHBn | 1687.91 | 844.96 | 844.44 |
| 527 | SP-506 | Ac-LTF$r8HYWAQL$S-NHPe | 1700.92 | 851.46 | 851.99 |

TABLE 4-continued

| SEQ ID NO: | SP | Seq | Exact Mass | M + 2 | Observed mass (m/e) |
|---|---|---|---|---|---|
| 528 | SP-507 | Ac-LTF$r8HYWAQL$S-NHChx | 1679.94 | 840.97 | 841.04 |
| 529 | SP-508 | Ac-ETF$r8AYWAQL$S-NH2 | 1547.80 | 774.90 | 774.96 |
| 530 | SP-509 | Ac-STF$r8AYWAQL$S-NH2 | 1505.79 | 753.90 | 753.94 |
| 531 | SP-510 | Ac-TFF$r8AYWAQL$S-NH2 | 1559.84 | 780.92 | 781.25 |
| 532 | SP-511 | Ac-LSF$r8AYWAQL$S-NH2 | 1517.83 | 759.92 | 759.93 |
| 533 | SP-512 | Ac-LTF$r8EYWAQL$S-NH2 | 1589.85 | 795.93 | 795.97 |
| 534 | SP-513 | Ac-LTF$r8SYWAQL$S-NH2 | 1547.84 | 774.92 | 774.96 |
| 535 | SP-514 | Ac-LTF$r8AYWEQL$S-NH2 | 1589.85 | 795.93 | 795.9 |
| 536 | SP-515 | Ac-LTF$r8AYWAEL$S-NH2 | 1532.83 | 767.42 | 766.96 |
| 537 | SP-516 | Ac-LTF$r8AYWASL$S-NH2 | 1490.82 | 746.41 | 746.46 |
| 538 | SP-517 | Ac-LTF$r8AYWAQL$E-NH2 | 1573.85 | 787.93 | 787.98 |
| 539 | SP-518 | Ac-LTF2CN$r8HYWAQL$S-NH2 | 1622.86 | 812.43 | 812.47 |
| 540 | SP-519 | Ac-LTF3CL$r8HYWAQL$S-NH2 | 1631.83 | 816.92 | 816.99 |
| 541 | SP-520 | Ac-LTDip$r8HYWAQL$S-NH2 | 1673.90 | 837.95 | 838.01 |
| 542 | SP-521 | Ac-LTF$r8HYWAQTle$S-NH2 | 1597.87 | 799.94 | 800.04 |
| 543 | SP-522 | Ac-F$r8AY6clWEAL$A-NH2 | 1336.66 | 669.33 | 1338.56 |
| 544 | SP-523 | Ac-F$r8AYd16brWEAL$A-NH2 | 1380.61 | 691.31 | 692.2 |
| 545 | SP-524 | Ac-F$r8AYd16fWEAL$A-NH2 | 1320.69 | 661.35 | 1321.61 |
| 546 | SP-525 | Ac-F$r8AYd14mWEAL$A-NH2 | 1316.72 | 659.36 | 659.36 |
| 547 | SP-526 | Ac-F$r8AYd15clWEAL$A-NH2 | 1336.66 | 669.33 | 669.35 |
| 548 | SP-527 | Ac-F$r8AYd17mWEAL$A-NH2 | 1316.72 | 659.36 | 659.36 |
| 549 | SP-528 | Ac-LTF%r8HYWAQL%A-NH2 | 1583.89 | 792.95 | 793.01 |
| 550 | SP-529 | Ac-LTF$r8HCouWAQL$S-NH2 | 1679.87 | 840.94 | 841.38 |
| 551 | SP-530 | Ac-LTFEHCouWAQLTS-NH2 | 1617.75 | 809.88 | 809.96 |
| 552 | SP-531 | Ac-LTA$r8HCouWAQL$S-NH2 | 1603.84 | 802.92 | 803.36 |
| 553 | SP-532 | Ac-F$r8AYWEAL$AbuA-NH2 | 1387.75 | 694.88 | 694.88 |
| 554 | SP-533 | Ac-F$r8AYWEAI$AA-NH2 | 1373.74 | 687.87 | 687.93 |
| 555 | SP-534 | Ac-F$r8AYWEANle$AA-NH2 | 1373.74 | 687.87 | 687.93 |
| 556 | SP-535 | Ac-F$r8AYWEAmlL$AA-NH2 | 1429.80 | 715.90 | 715.97 |
| 557 | SP-536 | Ac-F$r8AYWQAL$AA-NH2 | 1372.75 | 687.38 | 687.48 |
| 558 | SP-537 | Ac-F$r8AYWAAL$AA-NH2 | 1315.73 | 658.87 | 658.92 |
| 559 | SP-538 | Ac-F$r8AYWAbuAL$AA-NH2 | 1329.75 | 665.88 | 665.95 |
| 560 | SP-539 | Ac-F$r8AYWNleAL$AA-NH2 | 1357.78 | 679.89 | 679.94 |
| 561 | SP-540 | Ac-F$r8AbuYWEAL$AA-NH2 | 1387.75 | 694.88 | 694.96 |
| 562 | SP-541 | Ac-F$r8NleYWEAL$AA-NH2 | 1415.79 | 708.90 | 708.94 |
| 563 | SP-542 | Ac-F$r8FYWEAL$AA-NH2 | 1449.77 | 725.89 | 725.97 |
| 564 | SP-543 | Ac-LTF$r8HYWAQhL$S-NH2 | 1611.88 | 806.94 | 807 |
| 565 | SP-544 | Ac-LTF$r8HYWAQAdm$S-NH2 | 1675.91 | 838.96 | 839.04 |

TABLE 4-continued

| SEQ ID NO: | SP | Seq | Exact Mass | M + 2 | Observed mass (m/e) |
|---|---|---|---|---|---|
| 566 | SP-545 | Ac-LTF$r8HYWAQIgl$S-NH2 | 1659.88 | 830.94 | 829.94 |
| 567 | SP-546 | Ac-F$r8AYWAQL$AA-NH2 | 1372.75 | 687.38 | 687.48 |
| 568 | SP-547 | Ac-LTF$r8ALWAQL$Q-NH2 | 1522.89 | 762.45 | 762.52 |
| 569 | SP-548 | Ac-F$r8AYWEAL$AA-NH2 | 1373.74 | 687.87 | 687.93 |
| 570 | SP-549 | Ac-F$r8AYWENleL$AA-NH2 | 1415.79 | 708.90 | 708.94 |
| 571 | SP-550 | Ac-F$r8AYWEAibL$Abu-NH2 | 1330.73 | 666.37 | 666.39 |
| 572 | SP-551 | Ac-F$r8AYWENleL$Abu-NH2 | 1358.76 | 680.38 | 680.38 |
| 573 | SP-552 | Ac-F$r8AYWEAL$Abu-NH2 | 1316.72 | 659.36 | 659.36 |
| 574 | SP-553 | Ac-F$r8AYWEAc3cL$AbuA-NH2 | 1399.75 | 700.88 | 700.95 |
| 575 | SP-554 | Ac-F$r8AYWEAc3cL$NleA-NH2 | 1427.79 | 714.90 | 715.01 |
| 576 | SP-555 | H-LTF$r8AYWAQL$S-NH2 | 1489.83 | 745.92 | 745.95 |
| 577 | SP-556 | mdPEG3-LTF$r8AYWAQL$S-NH2 | 1679.92 | 840.96 | 840.97 |
| 578 | SP-557 | mdPEG7-LTF$r8AYWAQL$S-NH2 | 1856.02 | 929.01 | 929.03 |
| 579 | SP-558 | Ac-F$r8ApmpEt6clWEAL$A-NH2 | 1470.71 | 736.36 | 788.17 |
| 580 | SP-559 | Ac-LTF3CL$r8AYWAQL$S-NH2 | 1565.81 | 783.91 | 809.18 |
| 581 | SP-560 | Ac-LTF3CL$r8HYWAQL$A-NH2 | 1615.83 | 808.92 | 875.24 |
| 582 | SP-561 | Ac-LTF3CL$r8HYWWQL$S-NH2 | 1746.87 | 874.44 | 841.65 |
| 583 | SP-562 | Ac-LTF3CL$r8AYWWQL$S-NH2 | 1680.85 | 841.43 | 824.63 |
| 584 | SP-563 | Ac-LTF$r8AYWWQL$S-NH2 | 1646.89 | 824.45 | 849.98 |
| 585 | SP-564 | Ac-LTF$r8HYWWQL$A-NH2 | 1696.91 | 849.46 | 816.67 |
| 586 | SP-565 | Ac-LTF$r8AYWWQL$A-NH2 | 1630.89 | 816.45 | 776.15 |
| 587 | SP-566 | Ac-LTF4F$r8AYWAQL$S-NH2 | 1549.83 | 775.92 | 776.15 |
| 588 | SP-567 | Ac-LTF2F$r8AYWAQL$S-NH2 | 1549.83 | 775.92 | 776.15 |
| 589 | SP-568 | Ac-LTF3F$r8AYWAQL$S-NH2 | 1549.83 | 775.92 | 785.12 |
| 590 | SP-569 | Ac-LTF34F2$r8AYWAQL$S-NH2 | 1567.83 | 784.92 | 785.12 |
| 591 | SP-570 | Ac-LTF35F2Sr8AYWAQL$S-NH2 | 1567.83 | 784.92 | 1338.74 |
| 592 | SP-571 | Ac-F3CL$r8AYWEAL$A-NH2 | 1336.66 | 669.33 | 705.28 |
| 593 | SP-572 | Ac-F3CL$r8AYWEAL$AA-NH2 | 1407.70 | 704.85 | 680.11 |
| 594 | SP-573 | Ac-F$r8AY6clWEAL$AA-NH2 | 1407.70 | 704.85 | 736.83 |
| 595 | SP-574 | Ac-F$r8AY6clWEAL$-NH2 | 1265.63 | 633.82 | 784.1 |
| 596 | SP-575 | Ac-LTF$r8HYWAQLSt/S-NH2 | 16.03 | 9.02 | 826.98 |
| 597 | SP-576 | Ac-LTF$r8HYWAQL$S-NHsBu | 1653.93 | 827.97 | 828.02 |
| 598 | SP-577 | Ac-STF$r8AYWAQL$S-NH2 | 1505.79 | 753.90 | 753.94 |
| 599 | SP-578 | Ac-LTF$r8AYWAEL$S-NH2 | 1532.83 | 767.42 | 767.41 |
| 600 | SP-579 | Ac-LTF$r8AYWAQL$E-NH2 | 1573.85 | 787.93 | 787.98 |
| 601 | SP-580 | mdPEG3-LTF$r8AYWAQL$S-NH2 | 1679.92 | 840.96 | 840.97 |
| 602 | SP-581 | Ac-LTF$r8AYWAQhL$S-NH2 | 1545.86 | 773.93 | 774.31 |
| 603 | SP-583 | Ac-LTF$r8AYWAQCha$S-NH2 | 1571.88 | 786.94 | 787.3 |
| 604 | SP-584 | Ac-LTF$r8AYWAQChg$S-NH2 | 1557.86 | 779.93 | 780.4 |

TABLE 4-continued

| SEQ ID NO: | SP | Seq | Exact Mass | M + 2 | Observed mass (m/e) |
|---|---|---|---|---|---|
| 605 | SP-585 | Ac-LTF$r8AYWAQCba$S-NH2 | 1543.84 | 772.92 | 780.13 |
| 606 | SP-586 | Ac-LTF$r8AYWAQF$S-NH2 | 1565.83 | 783.92 | 784.2 |
| 607 | SP-587 | Ac-LTF4F$r8HYWAQhL$S-NH2 | 1629.87 | 815.94 | 815.36 |
| 608 | SP-588 | Ac-LTF4F$r8HYWAQCha$S-NH2 | 1655.89 | 828.95 | 828.39 |
| 609 | SP-589 | Ac-LTF4F$r8HYWAQChg$S-NH2 | 1641.87 | 821.94 | 821.35 |
| 610 | SP-590 | Ac-LTF4F$r8HYWAQCba$S-NH2 | 1627.86 | 814.93 | 814.32 |
| 611 | SP-591 | Ac-LTF4F$r8AYWAQhL$S-NH2 | 1563.85 | 782.93 | 782.36 |
| 612 | SP-592 | Ac-LTF4F$r8AYWAQCha$S-NH2 | 1589.87 | 795.94 | 795.38 |
| 613 | SP-593 | Ac-LTF4F$r8AYWAQChg$S-NH2 | 1575.85 | 788.93 | 788.35 |
| 614 | SP-594 | Ac-LTF4F$r8AYWAQCba$S-NH2 | 1561.83 | 781.92 | 781.39 |
| 615 | SP-595 | Ac-LTF3CL$r8AYWAQhL$S-NH2 | 1579.82 | 790.91 | 790.35 |
| 616 | SP-596 | Ac-LTF3CL$r8AYWAQCha$S-NH2 | 1605.84 | 803.92 | 803.67 |
| 617 | SP-597 | Ac-LTF3CL$r8AYWAQChg$S-NH2 | 1591.82 | 796.91 | 796.34 |
| 618 | SP-598 | Ac-LTF3CL$r8AYWAQCba$S-NH2 | 1577.81 | 789.91 | 789.39 |
| 619 | SP-599 | Ac-LTF$r8AYWAQhF$S-NH2 | 1579.84 | 790.92 | 791.14 |
| 620 | SP-600 | Ac-LTF$r8AYWAQF3CF3$S-NH2 | 1633.82 | 817.91 | 818.15 |
| 621 | SP-601 | Ac-LTF$r8AYWAQF3Me$S-NH2 | 1581.86 | 791.93 | 791.32 |
| 622 | SP-602 | Ac-LTF$r8AYWAQ1Nal$S-NH2 | 1615.84 | 808.92 | 809.18 |
| 623 | SP-603 | Ac-LTF$r8AYWAQBip$S-NH2 | 1641.86 | 821.93 | 822.13 |
| 624 | SP-604 | Ac-LTF$r8FYWAQL$A-NH2 | 1591.88 | 796.94 | 797.33 |
| 625 | SP-605 | Ac-LTF$r8HYWAQL$S-NHAm | 1667.94 | 834.97 | 835.92 |
| 626 | SP-606 | Ac-LTF$r8HYWAQL$S-NHiAm | 1667.94 | 834.97 | 835.55 |
| 627 | SP-607 | Ac-LTF$r8HYWAQL$S-NHnPr3Ph | 1715.94 | 858.97 | 859.79 |
| 628 | SP-608 | Ac-LTF$r8HYWAQL$S-NHnBu3,3Me | 1681.96 | 841.98 | 842.49 |
| 629 | SP-610 | Ac-LTF$r8HYWAQL$S-NHnPr | 1639.91 | 820.96 | 821.58 |
| 630 | SP-611 | Ac-LTF$r8HYWAQL$S-NHnEt2Ch | 1707.98 | 854.99 | 855.35 |
| 631 | SP-612 | Ac-LTF$r8HYWAQL$S-NHHex | 1681.96 | 841.98 | 842.4 |
| 632 | SP-613 | Ac-LTF$r8AYWAQL$S-NHmdPeg2 | 1633.91 | 817.96 | 818.35 |
| 633 | SP-614 | Ac-LTF$r8AYWAQL$A-NHmdPeg2 | 1617.92 | 809.96 | 810.3 |
| 634 | SP-615 | Ac-LTF$r8AYWAQL$A-NHmdPeg4 | 1705.97 | 853.99 | 854.33 |
| 635 | SP-616 | Ac-F$r8AYd14mWEAL$A-NH2 | 1316.72 | 659.36 | 659.44 |
| 636 | SP-617 | Ac-F$r8AYd15clWEAL$A-NH2 | 1336.66 | 669.33 | 669.43 |
| 637 | SP-618 | Ac-LThF$r8AYWAQL$S-NH2 | 1545.86 | 773.93 | 774.11 |
| 638 | SP-619 | Ac-LT2Nal$r8AYWAQL$S-NH2 | 1581.86 | 791.93 | 792.43 |
| 639 | SP-620 | Ac-LTA$r8AYWAQL$S-NH2 | 1455.81 | 728.91 | 729.15 |
| 640 | SP-621 | Ac-LTF$r8AYWVQL$S-NH2 | 1559.88 | 780.94 | 781.24 |
| 641 | SP-622 | Ac-LTF$r8HYWAAL$A-NH2 | 1524.85 | 763.43 | 763.86 |
| 642 | SP-623 | Ac-LTF$r8VYWAQL$A-NH2 | 1543.88 | 772.94 | 773.37 |

TABLE 4-continued

| SEQ ID NO: | SP | Seq | Exact Mass | M + 2 | Observed mass (m/e) |
|---|---|---|---|---|---|
| 643 | SP-624 | Ac-LTF$r8IYWAQL$S-NH2 | 1573.89 | 787.95 | 788.17 |
| 644 | SP-625 | Ac-FTF$r8VYWSQL$S-NH2 | 1609.85 | 805.93 | 806.22 |
| 645 | SP-626 | Ac-ITF$r8FYWAQL$S-NH2 | 1607.88 | 804.94 | 805.2 |
| 646 | SP-627 | Ac-2NalTF$r8VYWSQL$S-NH2 | 1659.87 | 830.94 | 831.2 |
| 647 | SP-628 | Ac-ITF$r8LYWSQL$S-NH2 | 1589.89 | 795.95 | 796.13 |
| 648 | SP-629 | Ac-FTF$r8FYWAQL$S-NH2 | 1641.86 | 821.93 | 822.13 |
| 649 | SP-630 | Ac-WTF$r8VYWAQL$S-NH2 | 1632.87 | 817.44 | 817.69 |
| 650 | SP-631 | Ac-WTF$r8WYWAQL$S-NH2 | 1719.88 | 860.94 | 861.36 |
| 651 | SP-632 | Ac-VTF$r8AYWSQL$S-NH2 | 1533.82 | 767.91 | 768.19 |
| 652 | SP-633 | Ac-WTF$r8FYWSQL$S-NH2 | 1696.87 | 849.44 | 849.7 |
| 653 | SP-634 | Ac-FTF$r8IYWAQL$S-NH2 | 1607.88 | 804.94 | 805.2 |
| 654 | SP-635 | Ac-WTF$r8VYWSQL$S-NH2 | 1648.87 | 825.44 | 824.8 |
| 655 | SP-636 | Ac-FTF$r8LYWSQL$S-NH2 | 1623.87 | 812.94 | 812.8 |
| 656 | SP-637 | Ac-YTF$r8FYWSQL$S-NH2 | 1673.85 | 837.93 | 837.8 |
| 657 | SP-638 | Ac-LTF$r8AY6clWEAL$A-NH2 | 1550.79 | 776.40 | 776.14 |
| 658 | SP-639 | Ac-LTF$r8AY6clWSQL$S-NH2 | 1581.80 | 791.90 | 791.68 |
| 659 | SP-640 | Ac-F$r8AY6clWSAL$A-NH2 | 1294.65 | 648.33 | 647.67 |
| 660 | SP-641 | Ac-F$r8AY6clWQAL$AA-NH2 | 1406.72 | 704.36 | 703.84 |
| 661 | SP-642 | Ac-LHF$r8AYWAQL$S-NH2 | 1567.86 | 784.93 | 785.21 |
| 662 | SP-643 | Ac-LTF$r8AYWAQL$S-NH2 | 1531.84 | 766.92 | 767.17 |
| 663 | SP-644 | Ac-LTF$r8AHWAQL$S-NH2 | 1505.84 | 753.92 | 754.13 |
| 664 | SP-645 | Ac-LTF$r8AYWAHL$S-NH2 | 1540.84 | 771.42 | 771.61 |
| 665 | SP-646 | Ac-LTF$r8AYWAQL$H-NH2 | 1581.87 | 791.94 | 792.15 |
| 666 | SP-647 | H-LTF$r8AYWAQL$A-NH2 | 1473.84 | 737.92 | 737.29 |
| 667 | SP-648 | Ac-HHF$r8AYWAQL$S-NH2 | 1591.83 | 796.92 | 797.35 |
| 668 | SP-649 | Ac-aAibWTF$r8VYWSQL$S-NH2 | 1804.96 | 903.48 | 903.64 |
| 669 | SP-650 | Ac-AibWTF$r8HYWAQL$S-NH2 | 1755.91 | 878.96 | 879.4 |
| 670 | SP-651 | Ac-AibAWTF$r8HYWAQL$S-NH2 | 1826.95 | 914.48 | 914.7 |
| 671 | SP-652 | Ac-AVTF$r8HYWAQL$S-NH2 | 1817.93 | 909.97 | 910.1 |
| 672 | SP-653 | Ac-AibWWTF$r8HYWAQL$S-NH2 | 1941.99 | 972.00 | 972.2 |
| 673 | SP-654 | Ac-WTF$r8LYWSQL$S-NH2 | 1662.88 | 832.44 | 832.8 |
| 674 | SP-655 | Ac-WTF$r8NleYWSQL$S-NH2 | 1662.88 | 832.44 | 832.6 |
| 675 | SP-656 | Ac-LTF$r8AYWSQL$a-NH2 | 1531.84 | 766.92 | 767.2 |
| 676 | SP-657 | Ac-LTF$r8EYWARL$A-NH2 | 1601.90 | 801.95 | 802.1 |
| 677 | SP-658 | Ac-LTF$r8EYWAHL$A-NH2 | 1582.86 | 792.43 | 792.6 |
| 678 | SP-659 | Ac-aTF$r8AYWAQL$S-NH2 | 1489.80 | 745.90 | 746.08 |
| 679 | SP-660 | Ac-AibTF$r8AYWAQL$S-NH2 | 1503.81 | 752.91 | 753.11 |
| 680 | SP-661 | Ac-Amtl1-$r8AYWAQL$S-NH2 | 1579.84 | 790.92 | 791.14 |
| 681 | SP-662 | Ac-AmwTF$r8AYWAQL$S-NH2 | 1618.86 | 810.43 | 810.66 |

TABLE 4-continued

| SEQ ID NO: | SP | Seq | Exact Mass | M + 2 | Observed mass (m/e) |
|---|---|---|---|---|---|
| 682 | SP-663 | Ac-NmLTF$r8AYWAQL$S-NH2 | 1545.86 | 773.93 | 774.11 |
| 683 | SP-664 | Ac-LNmTF$r8AYWAQL$S-NH2 | 1545.86 | 773.93 | 774.11 |
| 684 | SP-665 | Ac-LSarF$r8AYWAQL$S-NH2 | 1501.83 | 751.92 | 752.18 |
| 685 | SP-667 | Ac-LGF$r8AYWAQL$S-NH2 | 1487.82 | 744.91 | 745.15 |
| 686 | SP-668 | Ac-LTNmF$r8AYWAQL$S-NH2 | 1545.86 | 773.93 | 774.2 |
| 687 | SP-669 | Ac-TF$r8AYWAQL$S-NH2 | 1418.76 | 710.38 | 710.64 |
| 688 | SP-670 | Ac-ETF$r8AYWAQL$A-NH2 | 1531.81 | 766.91 | 767.2 |
| 689 | SP-671 | Ac-LTF$r8EYWAQL$A-NH2 | 1573.85 | 787.93 | 788.1 |
| 690 | SP-672 | Ac-LT2Nal$r8AYWSQL$S-NH2 | 1597.85 | 799.93 | 800.4 |
| 691 | SP-673 | Ac-LTF$r8AYWAAL$S-NH2 | 1474.82 | 738.41 | 738.68 |
| 692 | SP-674 | Ac-LTF$r8AYWAhCha$S-NH2 | 1585.89 | 793.95 | 794.19 |
| 693 | SP-675 | Ac-LTF$r8AYWAQChg$S-NH2 | 1557.86 | 779.93 | 780.97 |
| 694 | SP-676 | Ac-LTF$r8AYWAQCba$S-NH2 | 1543.84 | 772.92 | 773.19 |
| 695 | SP-677 | Ac-LTF$r8AYWAQF3CF3$S-NH2 | 1633.82 | 817.91 | 818.15 |
| 696 | SP-678 | Ac-LTF$r8AYWAQ1Nal$S-NH2 | 1615.84 | 808.92 | 809.18 |
| 697 | SP-679 | Ac-LTF$r8AYWAQBip$S-NH2 | 1641.86 | 821.93 | 822.32 |
| 698 | SP-680 | Ac-LT2Nal$r8AYWAQL$S-NH2 | 1581.86 | 791.93 | 792.15 |
| 699 | SP-681 | Ac-LTF$r8AYWVQL$S-NH2 | 1559.88 | 780.94 | 781.62 |
| 700 | SP-682 | Ac-LTF$r8AWWAQL$S-NH2 | 1554.86 | 778.43 | 778.65 |
| 701 | SP-683 | Ac-FTF$r8VYWSQL$S-NH2 | 1609.85 | 805.93 | 806.12 |
| 702 | SP-684 | Ac-ITF$r8FYWAQL$S-NH2 | 1607.88 | 804.94 | 805.2 |
| 703 | SP-685 | Ac-ITF$r8LYWSQL$S-NH2 | 1589.89 | 795.95 | 796.22 |
| 704 | SP-686 | Ac-FTF$r8FYWAQL$S-NH2 | 1641.86 | 821.93 | 822.41 |
| 705 | SP-687 | Ac-VTF$r8AYWSQL$S-NH2 | 1533.82 | 767.91 | 768.19 |
| 706 | SP-688 | Ac-LTF$r8AHWAQL$S-NH2 | 1505.84 | 753.92 | 754.31 |
| 707 | SP-689 | Ac-LTF$r8AYWAQL$H-NH2 | 1581.87 | 791.94 | 791.94 |
| 708 | SP-690 | Ac-LTF$r8AYWAHL$S-NH2 | 1540.84 | 771.42 | 771.61 |
| 709 | SP-691 | Ac-aAibWTF$r8VYWSQL$S-NH2 | 1804.96 | 903.48 | 903.9 |
| 710 | SP-692 | Ac-AibWTF$r8HYWAQL$S-NH2 | 1755.91 | 878.96 | 879.5 |
| 711 | SP-693 | Ac-AibAWTF$r8HYWAQL$S-NH2 | 1826.95 | 914.48 | 914.7 |
| 712 | SP-694 | Ac-fWTF$r8HYWAQL$S-NH2 | 1817.93 | 909.97 | 910.2 |
| 713 | SP-695 | Ac-AibWWTF$r8HYWAQL$S-NH2 | 1941.99 | 972.00 | 972.7 |
| 714 | SP-696 | Ac-WTF$r8LYWSQL$S-NH2 | 1662.88 | 832.44 | 832.7 |
| 715 | SP-697 | Ac-WTF$r8NleYWSQL$S-NH2 | 1662.88 | 832.44 | 832.7 |
| 716 | SP-698 | Ac-LTF$r8AYWSQL$a-NH2 | 1531.84 | 766.92 | 767.2 |
| 717 | SP-699 | Ac-LTF$r8EYWARL$A-NH2 | 1601.90 | 801.95 | 802.2 |
| 718 | SP-700 | Ac-LTF$r8EYWAHL$A-NH2 | 1582.86 | 792.43 | 792.6 |
| 719 | SP-701 | Ac-aTF$r8AYWAQL$S-NH2 | 1489.80 | 745.90 | 746.1 |

TABLE 4-continued

| SEQ ID NO: | SP | Seq | Exact Mass | M + 2 | Observed mass (m/e) |
|---|---|---|---|---|---|
| 720 | SP-702 | Ac-AibTF$r8AYWAQL$S-NH2 | 1503.81 | 752.91 | 753.2 |
| 721 | SP-703 | Ac-AmfTF$r8AYWAQL$S-NH2 | 1579.84 | 790.92 | 791.2 |
| 722 | SP-704 | Ac-AmwTF$r8AYWAQL$S-NH2 | 1618.86 | 810.43 | 810.7 |
| 723 | SP-705 | Ac-NmLTF$r8AYWAQL$S-NH2 | 1545.86 | 773.93 | 774.1 |
| 724 | SP-706 | Ac-LNmTF$r8AYWAQL$S-NH2 | 1545.86 | 773.93 | 774.4 |
| 725 | SP-707 | Ac-LSarF$r8AYWAQL$S-NH2 | 1501.83 | 751.92 | 752.1 |
| 726 | SP-708 | Ac-TF$r8AYWAQL$S-NH2 | 1418.76 | 710.38 | 710.8 |
| 727 | SP-709 | Ac-ETF$r8AYWAQL$A-NH2 | 1531.81 | 766.91 | 767.4 |
| 728 | SP-710 | Ac-LTF$r8EYWAQL$A-NH2 | 1573.85 | 787.93 | 788.2 |
| 729 | SP-711 | Ac-WTF$r8VYWSQL$S-NH2 | 1648.87 | 825.44 | 825.2 |
| 730 | SP-713 | Ac-YTF$r8FYWSQL$S-NH2 | 1673.85 | 837.93 | 837.3 |
| 731 | SP-714 | Ac-F$r8AY6clWSAL$A-NH2 | 1294.65 | 648.33 | 647.74 |
| 732 | SP-715 | Ac-ETF$r8EYWVQL$S-NH2 | 1633.84 | 817.92 | 817.36 |
| 733 | SP-716 | Ac-ETF$r8EHWAQL$A-NH2 | 1563.81 | 782.91 | 782.36 |
| 734 | SP-717 | Ac-ITF$r8EYWAQL$S-NH2 | 1589.85 | 795.93 | 795.38 |
| 735 | SP-718 | Ac-ITF$r8EHWVQL$A-NH2 | 1575.88 | 788.94 | 788.42 |
| 736 | SP-719 | Ac-ITF$r8EHWAQL$S-NH2 | 1563.85 | 782.93 | 782.43 |
| 737 | SP-720 | Ac-LTF4F$r8AYWAQCba$S-NH2 | 1561.83 | 781.92 | 781.32 |
| 738 | SP-721 | Ac-LTF3CL$r8AYWAQhL$S-NH2 | 1579.82 | 790.91 | 790.64 |
| 739 | SP-722 | Ac-LTF3CL$r8AYWAQCha$S-NH2 | 1605.84 | 803.92 | 803.37 |
| 740 | SP-723 | Ac-LTF3CL$r8AYWAQChg$S-NH2 | 1591.82 | 796.91 | 796.27 |
| 741 | SP-724 | Ac-LTF3CL$r8AYWAQCba$S-NH2 | 1577.81 | 789.91 | 789.83 |
| 742 | SP-725 | Ac-LTF$r8AY6clWSQL$S-NH2 | 1581.80 | 791.90 | 791.75 |
| 743 | SP-726 | Ac-LTF4F$r8HYWAQhL$S-NH2 | 1629.87 | 815.94 | 815.36 |
| 744 | SP-727 | Ac-LTF4F$r8HYWAQCba$S-NH2 | 1627.86 | 814.93 | 814.32 |
| 745 | SP-728 | Ac-LTF4F$r8AYWAQhL$S-NH2 | 1563.85 | 782.93 | 782.36 |
| 746 | SP-729 | Ac-LTF4F$r8AYWAQChg$S-NH2 | 1575.85 | 788.93 | 788.35 |
| 747 | SP-730 | Ac-ETF$r8EYWVAL$S-NH2 | 1576.82 | 789.41 | 788.79 |
| 748 | SP-731 | Ac-ETF$r8EHWAAL$A-NH2 | 1506.79 | 754.40 | 754.8 |
| 749 | SP-732 | Ac-ITF$r8EYWAAL$S-NH2 | 1532.83 | 767.42 | 767.75 |
| 750 | SP-733 | Ac-ITF$r8EHWVAL$A-NH2 | 1518.86 | 760.43 | 760.81 |
| 751 | SP-734 | Ac-ITF$r8EHWAAL$S-NH2 | 1506.82 | 754.41 | 754.8 |
| 752 | SP-735 | Pam-LTF$r8EYWAQL$S-NH2 | 1786.07 | 894.04 | 894.48 |
| 753 | SP-736 | Pam-ETF$r8EYWAQL$S-NH2 | 1802.03 | 902.02 | 902.34 |
| 754 | SP-737 | Ac-LTF$r8AYWLQL$S-NH2 | 1573.89 | 787.95 | 787.39 |
| 755 | SP-738 | Ac-LTF$r8EYWLQL$S-NH2 | 1631.90 | 816.95 | 817.33 |
| 756 | SP-739 | Ac-LTF$r8EHWLQL$S-NH2 | 1605.89 | 803.95 | 804.29 |
| 757 | SP-740 | Ac-LTF$r8VYWAQL$S-NH2 | 1559.88 | 780.94 | 781.34 |
| 758 | SP-741 | Ac-LTF$r8AYWSQL$S-NH2 | 1547.84 | 774.92 | 775.33 |

TABLE 4-continued

| SEQ ID NO: | SP | Seq | Exact Mass | M + 2 | Observed mass (m/e) |
|---|---|---|---|---|---|
| 759 | SP-742 | Ac-ETF$r8AYWAQL$S-NH2 | 1547.80 | 774.90 | 775.7 |
| 760 | SP-743 | Ac-LTF$r8EYWAQL$S-NH2 | 1589.85 | 795.93 | 796.33 |
| 761 | SP-744 | Ac-LTF$r8HYWAQL$S-NHAm | 1667.94 | 834.97 | 835.37 |
| 762 | SP-745 | Ac-LTF$r8HYWAQL$S-NHiAm | 1667.94 | 834.97 | 835.27 |
| 763 | SP-746 | Ac-LTF$r8HYWAQL$S-NHnPr3Ph | 1715.94 | 858.97 | 859.42 |
| 764 | SP-747 | Ac-LTF$r8HYWAQL$S-NHnBu3,3Me | 1681.96 | 841.98 | 842.67 |
| 765 | SP-748 | Ac-LTF$r8HYWAQL$S-NHnBu | 1653.93 | 827.97 | 828.24 |
| 766 | SP-749 | Ac-LTF$r8HYWAQL$S-NHnPr | 1639.91 | 820.96 | 821.31 |
| 767 | SP-750 | Ac-LTF$r8HYWAQL$S-NHnEt2Ch | 1707.98 | 854.99 | 855.35 |
| 768 | SP-751 | Ac-LTF$r8HYWAQL$S-NHHex | 1681.96 | 841.98 | 842.4 |
| 769 | SP-752 | Ac-LTF$r8AYWAQL$S-NHmdPeg2 | 1633.91 | 817.96 | 855.35 |
| 770 | SP-753 | Ac-LTF$r8AYWAQL$A-NHmdPeg2 | 1617.92 | 809.96 | 810.58 |
| 771 | SP-754 | Ac-LTF$r5AYWAAL$s8S-NH2 | 1474.82 | 738.41 | 738.79 |
| 772 | SP-755 | Ac-LTF$r8AYWCQuQL$S-NH2 | 1705.88 | 853.94 | 854.61 |
| 773 | SP-756 | Ac-LTF$r8CQuYWAQL$S-NH2 | 1705.88 | 853.94 | 854.7 |
| 774 | SP-757 | Ac-CQuTF$r8AYWAQL$S-NH2 | 1663.83 | 832.92 | 833.33 |
| 775 | SP-758 | H-LTF$r8AYWAQL$A-NH2 | 1473.84 | 737.92 | 737.29 |
| 776 | SP-759 | Ac-HHF$r8AYWAQL$S-NH2 | 1591.83 | 796.92 | 797.72 |
| 777 | SP-760 | Ac-LT2Nal$r8AYWSQL$S-NH2 | 1597.85 | 799.93 | 800.68 |
| 778 | SP-761 | Ac-LTF$r8HCouWAQL$S-NH2 | 1679.87 | 840.94 | 841.38 |
| 779 | SP-762 | Ac-LTF$r8AYWCou2QL$S-NH2 | 1789.94 | 895.97 | 896.51 |
| 780 | SP-763 | Ac-LTF$r8Cou2YWAQL$S-NH2 | 1789.94 | 895.97 | 896.5 |
| 781 | SP-764 | Ac-CQu2TF$r8AYWAQL$S-NH2 | 1747.90 | 874.95 | 875.42 |
| 782 | SP-765 | Ac-LTF$r8ACou2WAQL$S-NH2 | 1697.92 | 849.96 | 850.82 |
| 783 | SP-766 | Dmaac-LTF$r8AYWAQL$S-NH2 | 1574.89 | 788.45 | 788.82 |
| 784 | SP-767 | Hexac-LTF$r8AYWAQL$S-NH2 | 1587.91 | 794.96 | 795.11 |
| 785 | SP-768 | Napac-LTF$r8AYWAQL$S-NH2 | 1657.89 | 829.95 | 830.36 |
| 786 | SP-769 | Pam-LTF$r8AYWAQL$S-NH2 | 1728.06 | 865.03 | 865.45 |
| 787 | SP-770 | Ac-LT2Nal$r8HYAAQL$S-NH2 | 1532.84 | 767.42 | 767.61 |
| 788 | SP-771 | Ac-LT2Nal$/r8HYWAQMS-NH2 | 1675.91 | 838.96 | 839.1 |
| 789 | SP-772 | Ac-LT2Nal$r8HYFAQL$S-NH2 | 1608.87 | 805.44 | 805.9 |
| 790 | SP-773 | Ac-LT2Nal$r8HWAAQL$S -NH2 | 1555.86 | 778.93 | 779.08 |
| 791 | SP-774 | Ac-LT2Nal$r8HYAWQL$S-NH2 | 1647.88 | 824.94 | 825.04 |
| 792 | SP-775 | Ac-LT2Nal$r8HYAAQW$S-NH2 | 1605.83 | 803.92 | 804.05 |
| 793 | SP-776 | Ac-LTW$r8HYWAQL$S-NH2 | 1636.88 | 819.44 | 819.95 |
| 794 | SP-777 | Ac-LT1Nal$r8HYWAQL$S-NH2 | 1647.88 | 824.94 | 825.41 |

In the sequences shown above and elsewhere, the following abbreviations are used: "Nle" represents norleucine, "Aib" represents 2-aminoisobutyric acid, "Ac" represents acetyl, and "Pr" represents propionyl. Amino acids represented as "$" are alpha-Me S5-pentenyl-alanine olefin amino acids connected by an all-carbon i to i+4 crosslinker comprising one double bond. Amino acids represented as "$r5" are alpha-Me R5-pentenyl-alanine olefin amino acids connected by an all-carbon i to i+4 crosslinker comprising one double bond. Amino acids represented as "$s8" are alpha-Me S8-octenyl-alanine olefin amino acids connected by an all-carbon i to i+7 crosslinker comprising one double bond. Amino acids represented as "$r8" are alpha-Me R8-octenyl-alanine olefin amino acids connected by an all-carbon i to i+7 crosslinker comprising one double bond. "Ahx" represents an aminocyclohexyl linker. The crosslinkers are linear all-carbon crosslinker comprising eight or eleven carbon atoms between the alpha carbons of each amino acid. Amino acids represented as "$1" are alpha-Me S5-pentenyl-alanine olefin amino acids that are not connected by any crosslinker Amino acids represented as "$/r5" are alpha-Me R5-pentenyl-alanine olefin amino acids that are not connected by any crosslinker Amino acids represented as "$/s8" are alpha-Me S8-octenyl-alanine olefin amino acids that are not connected by any crosslinker Amino acids represented as "$/r8" are alpha-Me R8-octenyl-alanine olefin amino acids that are not connected by any crosslinker Amino acids represented as "Amw" are alpha-Me tryptophan amino acids. Amino acids represented as "Aml" are alpha-Me leucine amino acids. Amino acids represented as "2ff" are 2-fluoro-phenylalanine amino acids. Amino acids represented as "3ff" are 3-fluoro-phenylalanine amino acids. Amino acids represented as "St" are amino acids comprising two pentenyl-alanine olefin side chains, each of which is crosslinked to another amino acid as indicated. Amino acids represented as "SW" are amino acids comprising two pentenyl-alanine olefin side chains that are not crosslinked. Amino acids represented as "% St" are amino acids comprising two pentenyl-alanine olefin side chains, each of which is crosslinked to another amino acid as indicated via fully saturated hydrocarbon crosslinks.

For example, the compounds represented as SP-72, SP-56 and SP-138 have the following structures (SEQ ID NOS 109, 93 and 173, respectively, in order of appearance):

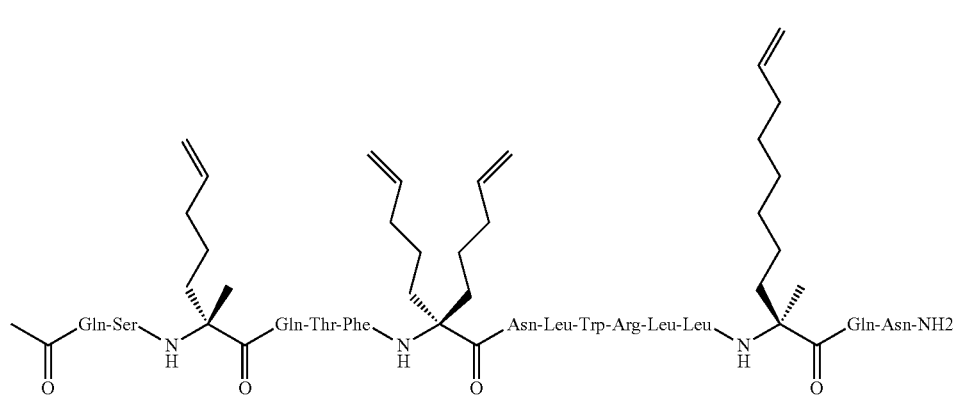

SP-72

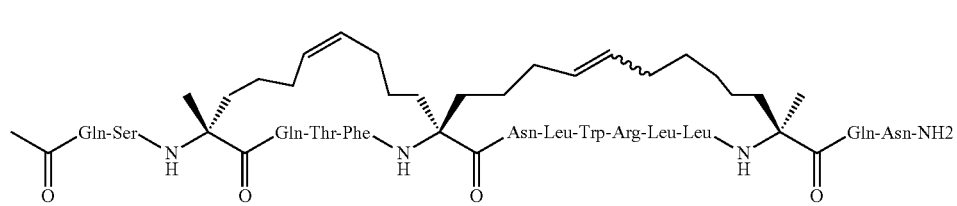

SP-56

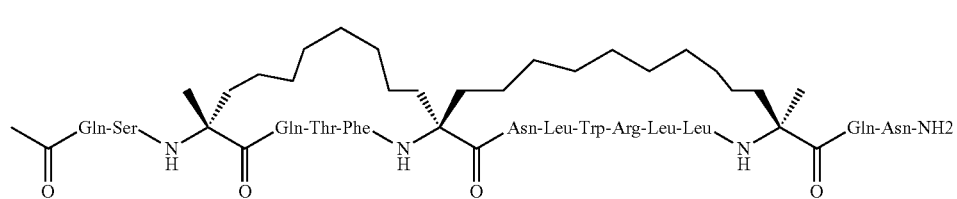

SP-138

For example, additional compounds have the following structures (SEQ ID NOS 83, 177, 303, 163, 225, 273, 366, 217, 214, 387 and 184, respectively, in order of appearance):

SP-46
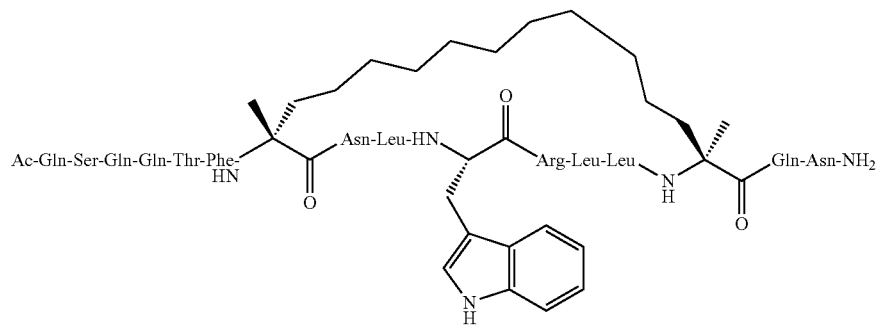
SP-142
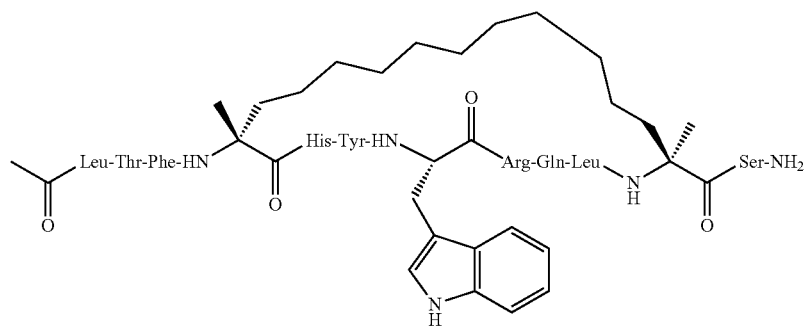
SP-280
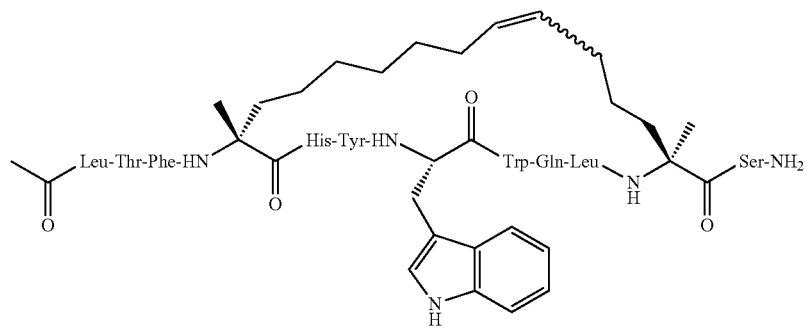
SP-128
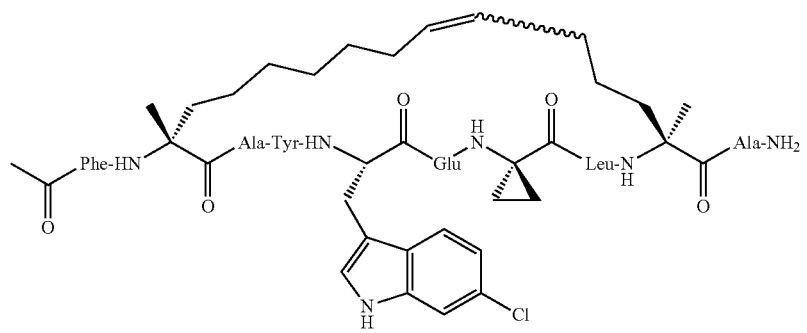
SP-201
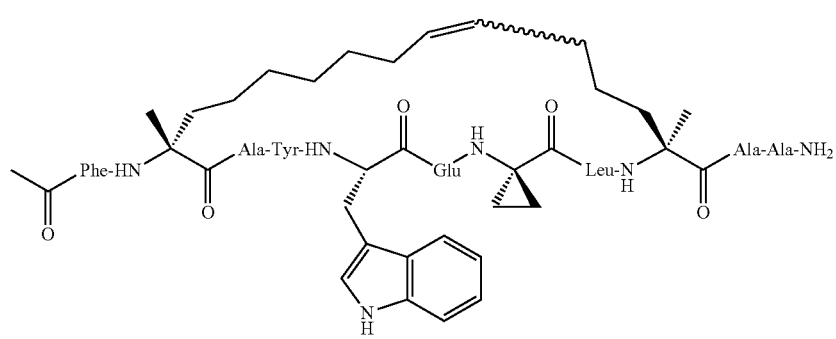

-continued
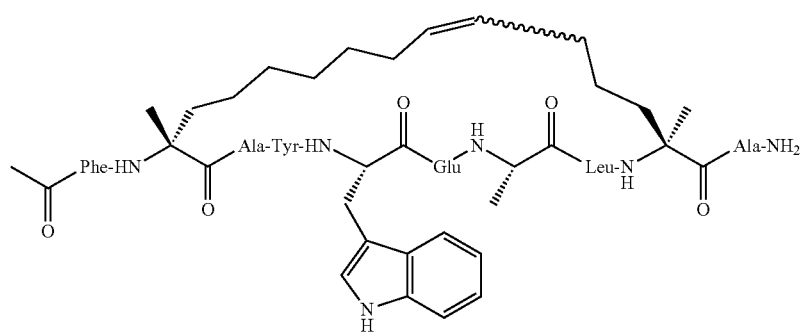
SP-250
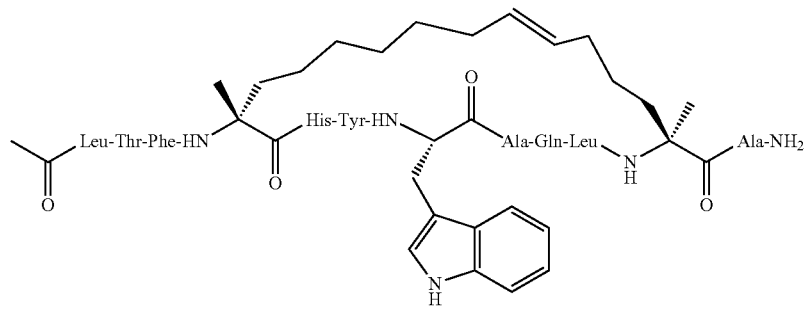
SP-343
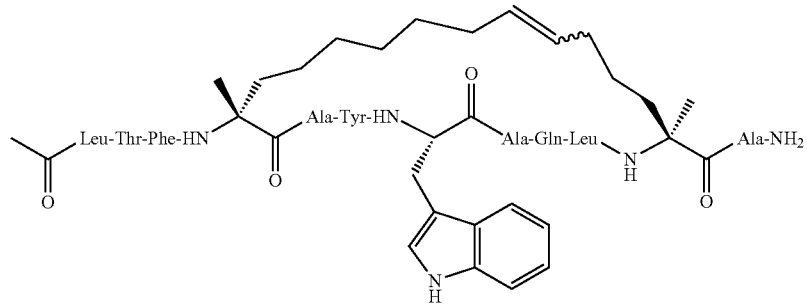
SP-193
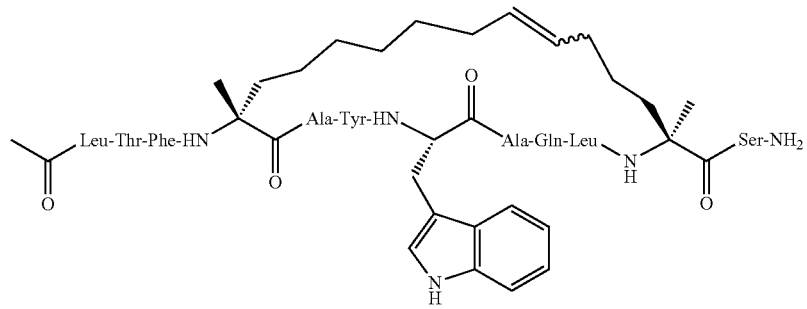
SP-190
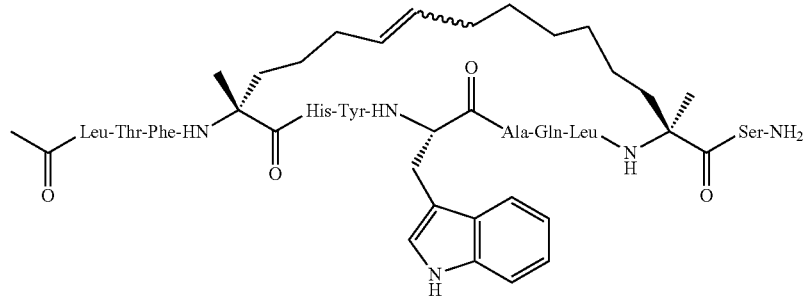
SP-364

SP-156

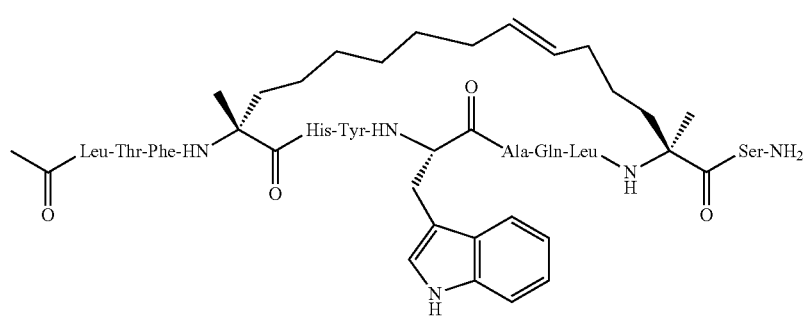

Example 3: Competition Binding ELISA (HDM2 & HDMX)

p53-His6 ("His6" disclosed as SEQ ID NO: 796) protein (30 nM/well) is coated overnight at room temperature in the wells of a 96-well Immulon plates. On the day of the experiment, plates are washed with 1×PBS-Tween 20 (0.05%) using an automated ELISA plate washer, blocked with ELISA Micro well Blocking for 30 minutes at room temperature; excess blocking agent is washed off by washing plates with 1×PBS-Tween 20 (0.05%). Peptides are diluted from 10 mM DMSO stocks to 500 working stocks in sterile water, further dilutions made in 0.5% DMSO to keep the concentration of DMSO constant across the samples. The peptides are added to wells at 2× desired concentrations in 50 µl volumes, followed by addition of diluted GST-HDM2 or GST-HMDX protein (final concentration: 10 nM). Samples are incubated at room temperature for 2 h, plates are washed with PBS-Tween 20 (0.05%) prior to adding 100 µl of HRP-conjugated anti-GST antibody [Hypromatrix, INC] diluted to 0.5 µg/ml in HRP-stabilizing buffer. Post 30 min incubation with detection antibody, plates are washed and incubated with 100 µl per well of TMB-E Substrate solution up to 30 minutes; reactions are stopped using 1M HCL and absorbance measured at 450 nm on micro plate reader. Data is analyzed using Graph Pad PRISM software.

Example 4: SJSA-1 Cell Viability Assay

SJSA1 cells are seeded at the density of 5000 cells/100 µl/well in 96-well plates a day prior to assay. On the day of study cells are washed once with Opti-MEM Media and 90 µL of the Opti-MEM Media is added to cells. Peptides are diluted from 10 mM DMSO stocks to 500 µM working stocks in sterile water, further dilutions made in 0.5% DMSO to keep the concentration of DMSO constant across the samples. The final concentration range µM will be 50, 25, 12.5, 6.25, 3.1, 1.56, 0.8 and 0 µM in 100 µL final volume per well for peptides. Final highest DMSO concentration is 0.5% and will be used as the negative control. Cayman Chemicals Cell-Based Assay (−)-Nutlin-3 (10 mM) is used as positive control. Nutlin was diluted using the same dilution scheme as peptides 10 µl of 10× desired concentrations is added to the appropriate well to achieve the final desired concentrations. Cells are then incubated with peptides for 20-24 h at 37° C. in humidified 5% CO2 atmosphere. Post-incubation period, cell viability is measured using Promega Cell Titer-Glo reagents according to manufacturer' instructions.

Example 5: SJSA-1 p21 Up-Regulation Assay

SJSA1 cells are seeded at the density of 0.8 million cells/2 ml/well in 6-well plates a day prior to assay. On the day of study cells are washed once with Opti-MEM Media and 1350 µL of the Opti-MEM Media is added to cells. Peptides are diluted from 10 mM DMSO stocks to 500 µM working stocks in sterile water, further dilutions made in 0.5% DMSO to keep the concentration of DMSO constant across the samples. Final highest DMSO concentration is 0.5% and is used as the negative control. Cayman Chemicals Cell-Based Assay (−)-Nutlin-3 (10 mM) is used as positive control. Nutlin is diluted using the same dilution scheme as peptides 150 µl of 10× desired concentrations is added to the appropriate well to achieve the final desired concentrations. Cells are then incubated with peptides for 18-20 h at 37° C. in humidified 5% CO2 atmosphere. Post-incubation period, cells are harvested, washed with 1×PBS (without Ca++/Mg++) and lysed in 1× Cell lysis buffer (Cell Signaling technologies 10× buffer diluted to 1× and supplemented with protease inhibitors and Phosphatase inhibitors) on ice for 30 min. Lysates are centrifuged at 13000 rpm speed in a microfuge at 40 C for 8 min; clear supernatants are collected and stored at −80° C. till further use. Total protein content of the lysates is measured using BCA protein detection kit and BSA standards from Thermofisher. 25 µg of the total protein is used for p21 detection ELISA assay. Each condition is set in triplicate for ELISA plate. The ELISA assay protocol is followed as per the manufacturer's instructions. 25 µg total protein used for each well, and each well is set up in triplicate. Data is analyzed using Graph Pad PRISM software.

Example 6: p53 GRIP Assay

Thermo Scientific*BioImage p53-Hdm2 Redistribution Assay monitors the protein interaction with Hdm2 and cellular translocation of GFP-tagged p53 in response to drug compounds or other stimuli. Recombinant CHO-hIR cells stably express human p53(1-312) fused to the C-terminus of enhanced green fluorescent protein (EGFP) and PDE4A4-Hdm2(1-124), a fusion protein between PDE4A4 and Hdm2 (1-124). They provide a ready-to-use assay system for measuring the effects of experimental conditions on the interaction of p53 and Hdm2. Imaging and analysis is performed with a HCS platform.

CHO-hIR cells are regularly maintained in Ham's F12 media supplemented with 1% Penicillin-Streptomycin, 0.5 mg/ml Geneticin, 1 mg/ml Zeocin and 10% FBS. Cells seeded into 96-well plates at the density of 7000 cells/100 µl per well 18-24 hours prior to running the assay using culture media. The next day, media is refreshed and PD177 is added to cells to the final concentration of 3 µM to activate foci formation. Control wells are kept without PD-177 solution. 24 h post stimulation with PD177, cells are washed once with Opti-MEM Media and 50 µL of the Opti-MEM Media supplemented with PD-177 (6 µM) is added to cells. Peptides are diluted from 10 mM DMSO stocks to 500 µM working stocks in sterile water, further dilutions made in 0.5% DMSO to keep the concentration of DMSO constant across the samples. Final highest DMSO concentration is 0.5% and is used as the negative control. Cayman Chemicals Cell-Based Assay (−)-Nutlin-3 (10 mM) is used as positive control. Nutlin was diluted using the same dilution scheme as peptides. 50 µl of 2× desired concentrations is added to the appropriate well to achieve the final desired concentrations. Cells are then incubated with peptides for 6 h at 37° C. in humidified 5% CO2 atmosphere. Post-incubation period, cells are fixed by gently aspirating out the media and adding 150 µl of fixing solution per well for 20 minutes at room temperature. Fixed cells are washed 4 times with 200 µl PBS per well each time. At the end of last wash, 100 µl of 1 µM Hoechst staining solution is added. Sealed plates incubated for at least 30 min in dark, washed with PBS to remove excess stain and PBS is added to each well. Plates can be stored at 4° C. in dark up to 3 days. The translocation of p53/HDM2 is imaged using Molecular translocation module on Cellomics Arrayscan instrument using 10× objective, XF-100 filter sets for Hoechst and GFP. The output parameters was Mean-CircRINGAveIntenRatio (the ratio of average fluorescence intensities of nucleus and cytoplasm, (well average)). The minimally acceptable number of cells per well used for image analysis was set to 500 cells.

Example 7: Direct Binding Assay hDM2 with Fluorescence Polarization (FP)

The assay was performed according to the following general protocol:
1. Dilute hDM2 (In-house, 41 kD) into FP buffer (High salt buffer-200 mM Nacl, 5 mM CHAPS, pH 7.5) to make 10 µM working stock solution.
2. Add 30 µl of 10 µM of protein stock solution into A1 and B1 well of 96-well black HE microplate (Molecular Devices).
3. Fill in 30 µl of FP buffer into column A2 to A12, B2 to B12, C1 to C12, and D1 to D12.
4. 2 or 3 fold series dilution of protein stock from A1, B1 into A2, B2; A2, B2 to A3, B3; . . . to reach the single digit nM concentration at the last dilution point.
5. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use. 6. Add 10 µl of 10 nM of FAM labeled peptide into each well and incubate, and read at different time points. Kd with 5-FAM-BaLTFEHYWAQLTS-NH$_2$ SEQ ID NO: 795) is ~13.38 nM.

Example 8: Competitive Fluorescence Polarization Assay for hDM2

The assay was performed according to the following general protocol:
1. Dilute hDM2 (In-house, 41 kD) into FP buffer (High salt buffer-200 mM Nacl, 5 mM CHAPS, pH 7.5) to make 84 nM (2×) working stock solution.
2. Add 20 µl of 84 nM (2×) of protein stock solution into each well of 96-well black HE microplate (Molecular Devices)
3. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
4. Make unlabeled peptide dose plate with FP buffer starting with 1 µM (final) of peptide and making 5 fold serial dilutions for 6 points using following dilution scheme.
Dilute 10 mM (in 100% DMSO) with DMSO to 5 mM (dilution 1:2). Then, dilute from 5 mM to 500 µM with H$_2$O (dilution 1:10) and then dilute with FP buffer from 500 µM to 20 µM (dilution 1:25). Making 5 fold serial dilutions from 4 µM (4×) for 6 points.
5. Transfer 10 µl of serial diluted unlabeled peptides to each well which is filled with 20 µl of 84 nM of protein.
6. Add 10 µl of 10 nM (4×) of FAM labeled peptide into each well and incubate for 3 hr to read. Results of Examples 7 and 8 are provided in HDM2 data in FIGS. 7A-D.

Example 9: Direct Binding Assay hDMX with Fluorescence Polarization (FP)

The assay was performed according to the following general protocol:
1. Dilute hDMX (In-house, 40 kD) into FP buffer (High salt buffer-200 mM Nacl, 5 mM CHAPS, pH 7.5) to make 10 µM working stock solution.
2. Add 30 µl of 10 µM of protein stock solution into A1 and B1 well of 96-well black HE microplate (Molecular Devices).
3. Fill in 30 µl of FP buffer into column A2 to A12, B2 to B12, C1 to C12, and D1 to D12.
4. 2 or 3 fold series dilution of protein stock from A1, B1 into A2, B2; A2, B2 to A3, B3; . . . to reach the single digit nM concentration at the last dilution point.
5. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
6. Add 10 µl of 10 nM of FAM labeled peptide into each well and incubate, and read at different time points.
Kd with 5-FAM-BaLTFEHYWAQLTS-NH$_2$ (SEQ ID NO: 795) is ~51 nM.

Example 10: Competitive Fluorescence Polarization Assay for hDMX

The assay was performed according to the following general protocol:
1. Dilute hDMX (In-house, 40 kD) into FP buffer (High salt buffer-200 mM Nacl, 5 mM CHAPS, pH 7.5) to make 300 nM (2×) working stock solution.
2. Add 20 µl of 300 nM (2×) of protein stock solution into each well of 96-well black HE microplate (Molecular Devices)
3. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
4. Make unlabeled peptide dose plate with FP buffer starting with 5 µM (final) of peptide and making 5 fold serial dilutions for 6 points using following dilution scheme.
5. Dilute 10 mM (in 100% DMSO) with DMSO to 5 mM (dilution 1:2). Then, dilute from 5 mM to 500 µM with $H_2O$ (dilution 1:10) and then dilute with FP buffer from 500 µM to 20 µM (dilution 1:25). Making 5 fold serial dilutions from 20 µM (4×) for 6 points.
6. Transfer 10 µl of serial diluted unlabeled peptides to each well which is filled with 20 µl of 300 nM of protein.
7. Add 10 µl of 10 nM (4×) of FAM labeled peptide into each well and incubate for 3 hr to read.
Results of Examples 9 and 10 are provided in HDMX data in FIGS. 7A-D.

Example 11: Cell Viability Assay

The assay was performed according to the following general protocol:
Cell Plating: Trypsinize, count and seed cells at the pre-determined densities in 96-well plates a day prior to assay. Following cell densities are used for each cell line in use:
SJSA-1: 7500 cells/well
RKO: 5000 cells/well
RKO-E6: 5000 cells/well
HCT-116: 5000 cells/well
SW-480: 2000 cells/well
MCF-7: 5000 cells/well
On the day of study, replace media with fresh media with 11% FBS (assay media) at room temperature. Add 180 µL of the assay media per well. Control wells with no cells, receive 200 µl media.
Peptide dilution: all dilutions are made at room temperature and added to cells at room temperature.
Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water. This gives range of 10× working stocks. Also prepare DMSO/sterile water (3% DMSO) mix for control wells.
Thus the working stocks concentration range µM will be 300, 100, 30, 10, 3, 1, 0.3 and 0 µM. Mix well at each dilution step using multichannel.
Row H has controls. H1-H3 will receive 20 ul of assay media. H4-H9 will receive 20 ul of 3% DMSO-water vehicle. H10-H12 will have media alone control with no cells.
Positive control: HDM2 small molecule inhibitor, Nutlin-3a (10 mM) is used as positive control. Nutlin was diluted using the same dilution scheme as peptides.
Addition of working stocks to cells:
Add 20 µl of 10× desired concentration to appropriate well to achieve the final concentrations in total 200 µl volume in well. (20 µl of 300 µM peptide+180 µl of cells in media=30 µM final concentration in 200 µl volume in wells). Mix gently a few times using pipette. Thus final concentration range used will be 30, 10, 3, 1, 0.3, 0.1, 0.03 & 0 µM (for potent peptides further dilutions are included).
Controls include wells that get no peptides but contain the same concentration of DMSO as the wells containing the peptides, and wells containing NO CELLS.
Incubate for 72 hours at 37° C. in humidified 5% $CO_2$ atmosphere.
The viability of cells is determined using MTT reagent from Promega. Viability of SJSA-1, RKO, RKO-E6, HCT-116 cells is determined on day 3, MCF-7 cells on day 5 and SW-480 cells on day 6. At the end of designated incubation time, allow the plates to come to room temperature. Remove 80 µl of assay media from each well. Add 15 µl of thawed MTT reagent to each well.
Allow plate to incubate for 2 h at 37° C. in humidified 5% $CO_2$ atmosphere and add 100 µl solubilization reagent as per manufacturer's protocol. Incubate with agitation for 1 h at room temperature and read on Synergy Biotek multiplate reader for absorbance at 570 nM.
Analyze the cell viability against the DMSO controls using GraphPad PRISM analysis tools.
Reagents:
Invitrogen cell culture Media
  i. Falcon 96-well clear cell culture treated plates (Nunc 353072)
DMSO (Sigma D 2650)
RPMI 1640 (Invitrogen 72400)
MTT (Promega G4000)
Instruments:
Multiplate Reader for Absorbance Readout (Synergy 2)
Results of Example 11 are provided in SJSA-1 EC50 data in FIGS. 7A-D.

Example 12: P21 ELISA Assay

The assay was performed according to the following general protocol:
Cell Plating:
Trypsinize, count and seed SJSA1 cells at the density of 7500 cells/100 µl/well in 96-well plates a day prior to assay.
On the day of study, replace media with fresh RPMI-11% FBS (assay media). Add 90 µL of the assay media per well. Control wells with no cells, receive 100 µl media.
Peptide Dilution:
Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water This gives range of 10× working stocks. Also prepare DMSO/sterile water (3% DMSO) mix for control wells.

Thus the working stocks concentration range μM will be 300, 100, 30, 10, 3, 1, 0.3 and 0 Mix well at each dilution step using multichannel.

Row H has controls. H1-H3 will receive 10 ul of assay media. H4-H9 will receive 10 ul of 3% DMSO-water vehicle. H10-H12 will have media alone control with no cells.

Positive control: HDM2 small molecule inhibitor, Nutlin-3a (10 mM) is used as positive control. Nutlin was diluted using the same dilution scheme as peptides.

Addition of Working Stocks to Cells:

Add 10 μl of 10× desired concentration to appropriate well to achieve the final concentrations in total 100 μl volume in well. (10 μl of 300 μM peptide+90 μl of cells in media=30 μM final concentration in 100 μl volume in wells). Thus final concentration range used will be 30, 10, 3, 1, 0.3 & 0 μM.

Controls will include wells that get no peptides but contain the same concentration of DMSO as the wells containing the peptides, and wells containing NO CELLS.

20 h-post incubation, aspirate the media; wash cells with 1×PBS (without $Ca^{++}/Mg^{++}$) and lyse in 60 μl of 1× Cell lysis buffer (Cell Signaling technologies 10× buffer diluted to 1× and supplemented with protease inhibitors and Phosphatase inhibitors) on ice for 30 min Centrifuge plates in at 5000 rpm speed in at 4° C. for 8 min; collect clear supernatants and freeze at −80° C. till further use.

Protein Estimation:

Total protein content of the lysates is measured using BCA protein detection kit and BSA standards from Thermofisher. Typically about 6-7 μg protein is expected per well.

Use 50 μl of the lysate per well to set up p21 ELISA.

Human Total p21 ELISA:

The ELISA assay protocol is followed as per the manufacturer's instructions. 50 μl lysate is used for each well, and each well is set up in triplicate.

Reagents:

Cell-Based Assay (−)-Nutlin-3 (10 mM): Cayman Chemicals, catalog #600034

OptiMEM, Invitrogen catalog #51985

Cell Signaling Lysis Buffer (10×), Cell signaling technology, Catalog #9803

Protease inhibitor Cocktail tablets (mini), Roche Chemicals, catalog #04693124001

Phosphatase inhibitor Cocktail tablet, Roche Chemicals, catalog #04906837001

Human total p21 ELISA kit, R&D Systems, DYC1047-5

STOP Solution (1M HCL), Cell Signaling Technologies, Catalog #7002

Instruments: Micro centrifuge-Eppendorf 5415D and Multiplate Reader for Absorbance readout (Synergy 2)

Results of Example 12 are provided in p21 data in FIGS. 7A-D.

Example 13: Caspase 3 Detection Assay

The assay was performed according to the following general protocol:

Cell Plating:

Trypsinize, count and seed SJSA1 cells at the density of 7500 cells/100 μl/well in 96-well plates a day prior to assay. On the day of study, replace media with fresh RPMI-11% FBS (assay media). Add 180 μL of the assay media per well. Control wells with no cells, receive 200 μl media.

Peptide Dilution:

Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water This gives range of 10× working stocks. Also prepare DMSO/sterile water (3% DMSO) mix for control wells.

Thus the working stocks concentration range μM will be 300, 100, 30, 10, 3, 1, 0.3 and 0 μM. Mix well at each dilution step using multichannel. Add 20 ul of 10× working stocks to appropriate wells.

Row H has controls. H1-H3 will receive 20 ul of assay media. H4-H9 will receive 20 ul of 3% DMSO-water vehicle. H10-H12 will have media alone control with no cells.

Positive control: HDM2 small molecule inhibitor, Nutlin-3a (10 mM) is used as positive control. Nutlin was diluted using the same dilution scheme as peptides.

Addition of Working Stocks to Cells:

Add 10 μl of 10× desired concentration to appropriate well to achieve the final concentrations in total 100 μl volume in well. (10 μl of 300 μM peptide+90 μl of cells in media=30 μM final concentration in 100 μl volume in wells). Thus final concentration range used will be 30, 10, 3, 1, 0.3 & 0 μM.

Controls will include wells that get no peptides but contain the same concentration of DMSO as the wells containing the peptides, and wells containing NO CELLS.

48 h-post incubation, aspirate 80 μl media from each well; add 100 μl Caspase3/7 Glo assay reagent (Promega Caspase 3/7 glo assay system, G8092) per well, incubate with gentle shaking for 1 h at room temperature.

read on Synergy Biotek multiplate reader for luminescence.

Data is analyzed as Caspase 3 activation over DMSO-treated cells.

Results of Example 13 are provided in p21 data in FIGS. 7A-D.

SEQUENCE LISTING (796 sequences)

SEQ ID NO: 1 - protein, 16 aa, Artificial Sequence
  Description of Artificial Sequence: Synthetic peptide
  N-term Ac
  C-term NH2
QSQQTFSNLWRLLPQN

SEQ ID NO: 2 - protein, 17 aa, Artificial Sequence
  Description of Artificial Sequence: Synthetic peptide
  N-term Ac
  MOD_RES (1)..(1): Any cross-linked amino acid
  MOD_RES (5)..(5): Any cross-linked amino acid
  C-term NH2
  Crosslinked Sequence
XQSQXTFSNLWRLLPQN

SEQ ID NO: 3 - protein, 16 aa, Artificial Sequence
  Description of Artificial Sequence: Synthetic peptide
  N-term Ac
  MOD_RES (1)..(1): Any cross-linked amino acid
  MOD_RES (5)..(5): Any cross-linked amino acid
  C-term NH2
  Crosslinked Sequence
XSQQXFSNLWRLLPQN

SEQ ID NO: 4 - protein, 16 aa, Artificial Sequence
  Description of Artificial Sequence: Synthetic peptide
  N-term Ac
  MOD_RES (3)..(3): Any cross-linked amino acid
  MOD_RES (7)..(7): Any cross-linked amino acid
  C-term NH2
  Crosslinked Sequence
QSXQTFXNLWRLLPQN

SEQ ID NO: 5 - protein, 16 aa, Artificial Sequence
  Description of Artificial Sequence: Synthetic peptide
  N-term Ac
  MOD_RES (4)..(4): Any cross-linked amino acid
  MOD_RES (8)..(8): Any cross-linked amino acid
  C-term NH2
  Crosslinked Sequence
QSQXTFSXLWRLLPQN

SEQ ID NO: 6 - protein, 16 aa, Artificial Sequence
  Description of Artificial Sequence: Synthetic peptide
  N-term Ac
  MOD_RES (5)..(5): Any cross-linked amino acid
  MOD_RES (9)..(9): Any cross-linked amino acid
  C-term NH2
  Crosslinked Sequence
QSQQXFSNXWRLLPQN

SEQ ID NO: 7 - protein, 16 aa, Artificial Sequence
  Description of Artificial Sequence: Synthetic peptide
  N-term Ac
  MOD_RES (7)..(7): Any cross-linked amino acid
  MOD_RES (11)..(11): Any cross-linked amino acid
  C-term NH2
  Crosslinked Sequence
QSQQTFXNLWXLLPQN

SEQ ID NO: 8 - protein, 16 aa, Artificial Sequence
  Description of Artificial Sequence: Synthetic peptide
  N-term Ac
  MOD_RES (8)..(8): Any cross-linked amino acid
  MOD_RES (12)..(12): Any cross-linked amino acid
  C-term NH2
  Crosslinked Sequence
QSQQTFSXLWRXLPQN

SEQ ID NO: 9 - protein, 16 aa, Artificial Sequence
  Description of Artificial Sequence: Synthetic peptide
  N-term Ac
  MOD_RES (11)..(11): Any cross-linked amino acid
  MOD_RES (15)..(15): Any cross-linked amino acid
  C-term NH2
  Crosslinked Sequence
QSQQTFSNLWXLLPXN

SEQ ID NO: 10 - protein, 16 aa, Artificial Sequence
  Description of Artificial Sequence: Synthetic peptide
  N-term Ac
  MOD_RES (12)..(12): Any cross-linked amino acid
  MOD_RES (16)..(16): Any cross-linked amino acid
  C-term NH2
  Crosslinked Sequence
QSQQTFSNLWRXLPQX

SEQ ID NO: 11 - protein, 17 aa, Artificial Sequence
  Description of Artificial Sequence: Synthetic peptide
  N-term Ac
  MOD_RES (1)..(1): Any cross-linked amino acid
  MOD_RES (8)..(8): Any cross-linked amino acid
  C-term NH2
  Crosslinked Sequence
XQSQQTFXNLWRLLPQN

SEQ ID NO: 12 - protein, 16 aa, Artificial Sequence
  Description of Artificial Sequence: Synthetic peptide
  N-term Ac
  MOD_RES (1)..(1): Any cross-linked amino acid
  MOD_RES (8)..(8): Any cross-linked amino acid
  C-term NH2
  Crosslinked Sequence
XSQQTFSXLWRLLPQN

SEQ ID NO: 13 - protein, 16 aa, Artificial Sequence
  Description of Artificial Sequence: Synthetic peptide
  N-term Ac
  MOD_RES (2)..(2): Any cross-linked amino acid
  MOD_RES (9)..(9): Any cross-linked amino acid
  C-term NH2
  Crosslinked Sequence
QXQQTFSNXWRLLPQN

SEQ ID NO: 14 - protein, 16 aa, Artificial Sequence
  Description of Artificial Sequence: Synthetic peptide
  N-term Ac
  MOD_RES (4)..(4): Any cross-linked amino acid
  MOD_RES (11)..(11): Any cross-linked amino acid
  C-term NH2
  Crosslinked Sequence
QSQXTFSNLWXLLPQN

SEQ ID NO: 15 - protein, 16 aa, Artificial Sequence
  Description of Artificial Sequence: Synthetic peptide
  N-term Ac
  MOD_RES (5)..(5): Any cross-linked amino acid
  MOD_RES (12)..(12): Any cross-linked amino acid
  C-term NH2
  Crosslinked Sequence
QSQQXFSNLWRXLPQN

SEQ ID NO: 16 - protein, 16 aa, Artificial Sequence
  Description of Artificial Sequence: Synthetic peptide
  N-term Ac
  MOD_RES (7)..(7): Any cross-linked amino acid
  MOD_RES (14)..(14): Any cross-linked amino acid
  C-term NH2
  Crosslinked Sequence
QSQQTFXNLWRLLXQN

SEQ ID NO: 17 - protein, 16 aa, Artificial Sequence
  Description of Artificial Sequence: Synthetic peptide
  N-term Ac
  MOD_RES (8)..(8): Any cross-linked amino acid
  MOD_RES (15)..(15): Any cross-linked amino acid
  C-term NH2
  Crosslinked Sequence
QSQQTFSXLWRLLPXN

SEQ ID NO: 18 - protein, 16 aa, Artificial Sequence
  Description of Artificial Sequence: Synthetic peptide
  N-term Ac
  MOD_RES (9)..(9): Any cross-linked amino acid
  MOD_RES (16)..(16): Any cross-linked amino acid
  C-term NH2
  Crosslinked Sequence
QSQQTFSNXWRLLPQX

SEQ ID NO: 19 - protein, 12 aa, Artificial Sequence
  Description of Artificial Sequence: Synthetic peptide
  N-term Ac
  C-term NH2
LTFEHYWAQLTS

SEQ ID NO: 20 - protein, 13 aa, Artificial Sequence
  Description of Artificial Sequence: Synthetic peptide
  N-term Ac
  MOD_RES (1)..(1): Any cross-linked amino acid
  MOD_RES (5)..(5): Any cross-linked amino acid
  C-term NH2
  Crosslinked Sequence
XLTFXHYWAQLTS

SEQ ID NO: 21 - protein, 12 aa, Artificial Sequence
  Description of Artificial Sequence: Synthetic peptide
  N-term Ac
  MOD_RES (1)..(1): Any cross-linked amino acid
  MOD_RES (5)..(5): Any cross-linked amino acid
  C-term NH2
  Crosslinked Sequence
XTFEXYWAQLTS

SEQ ID NO: 22 - protein, 12 aa, Artificial Sequence
  Description of Artificial Sequence: Synthetic peptide
  N-term Ac
  MOD_RES (2)..(2): Any cross-linked amino acid
  MOD_RES (6)..(6): Any cross-linked amino acid
  C-term NH2
  Crosslinked Sequence
LXFEHXWAQLTS

SEQ ID NO: 23 - protein, 12 aa, Artificial Sequence
  Description of Artificial Sequence: Synthetic peptide
  N-term Ac
  MOD_RES (4)..(4): Any cross-linked amino acid
  MOD_RES (8)..(8): Any cross-linked amino acid
  C-term NH2
  Crosslinked Sequence
LTFXHYWXQLTS

SEQ ID NO: 24 - protein, 12 aa, Artificial Sequence
  Description of Artificial Sequence: Synthetic peptide
  N-term Ac
  MOD_RES (5)..(5): Any cross-linked amino acid
  MOD_RES (9)..(9): Any cross-linked amino acid
  C-term NH2
  Crosslinked Sequence
LTFEXYWAXLTS

SEQ ID NO: 25 - protein, 12 aa, Artificial Sequence
  Description of Artificial Sequence: Synthetic peptide
  N-term Ac
  MOD_RES (8)..(8): Any cross-linked amino acid
  MOD_RES (12)..(12): Any cross-linked amino acid
  C-term NH2
  Crosslinked Sequence
LTFEHYWXQLTX

SEQ ID NO: 26 - protein, 13 aa, Artificial Sequence
  Description of Artificial Sequence: Synthetic peptide
  N-term Ac
  MOD_RES (9)..(9): Any cross-linked amino acid
  MOD_RES (13)..(13): Any cross-linked amino acid
  C-term NH2
  Crosslinked Sequence
LTFEHYWAXLTSX

SEQ ID NO: 27 - protein, 12 aa, Artificial Sequence
  Description of Artificial Sequence: Synthetic peptide
  N-term Ac
  MOD_RES (1)..(1): Any cross-linked amino acid
  MOD_RES (8)..(8): Any cross-linked amino acid
  C-term NH2
  Crosslinked Sequence
XTFEHYWXQLTS

SEQ ID NO: 28 - protein, 12 aa, Artificial Sequence
  Description of Artificial Sequence: Synthetic peptide
  N-term Ac
  MOD_RES (2)..(2): Any cross-linked amino acid
  MOD_RES (9)..(9): Any cross-linked amino acid
  C-term NH2
  Crosslinked Sequence
QXFEHYWAXLTS

SEQ ID NO: 29 - protein, 12 aa, Artificial Sequence
  Description of Artificial Sequence: Synthetic peptide
  N-term Ac
  MOD_RES (4)..(4): Any cross-linked amino acid
  MOD_RES (11)..(11): Any cross-linked amino acid
  C-term NH2
  Crosslinked Sequence
QTFXHYWAQLXS

SEQ ID NO: 30 - protein, 12 aa, Artificial Sequence
  Description of Artificial Sequence: Synthetic peptide
  N-term Ac
  MOD_RES (5)..(5): Any cross-linked amino acid
  MOD_RES (12)..(12): Any cross-linked amino acid
  C-term NH2
  Crosslinked Sequence
QTFEXYWAQLTX

SEQ ID NO: 31 - protein, 13 aa, Artificial Sequence
  Description of Artificial Sequence: Synthetic peptide
  N-term Ac
  MOD_RES (6)..(6): Any cross-linked amino acid
  MOD_RES (13)..(13): Any cross-linked amino acid
  C-term NH2
  Crosslinked Sequence
QTFEHXWAQLTSX

SEQ ID NO: 32 - protein, 8 aa, Artificial Sequence
  Description of Artificial Sequence: Synthetic peptide
  N-term Ac
  MOD_RES (3)..(3): 2-aminoisobutyric acid, His or Asn
  MOD_RES (5)..(5): 6-Cl-Trp
  MOD_RES (7)..(7): Aminocyclopropane carboxylic acid residue, Gln or Leu
  C-term NH2
  Crosslinked Sequence
FMXYWEXL

SEQ ID NO: 33 - protein, 9 aa, Artificial Sequence
  Description of Artificial Sequence: Synthetic peptide
  N-term Ac
  MOD_RES (1)..(1): Any cross-linked amino acid
  MOD_RES (4)..(4): 2-aminoisobutyric acid, His or Asn
  MOD_RES (5)..(5): Any cross-linked amino acid
  MOD_RES (6)..(6): 6-Cl-Trp
  MOD_RES (8)..(8): Aminocyclopropane carboxylic acid residue, Gln or Leu
  C-term NH2
  Crosslinked Sequence
XFMXXWEXL

SEQ ID NO: 34 - protein, 8 aa, Artificial Sequence
  Description of Artificial Sequence: Synthetic peptide
  N-term Ac
  MOD_RES (2)..(2): Any cross-linked amino acid
  MOD_RES (3)..(3): 2-aminoisobutyric acid, His or Asn
  MOD_RES (5)..(5): 6-Cl-Trp
  MOD_RES (6)..(6): Any cross-linked amino acid
  MOD_RES (7)..(7): Aminocyclopropane carboxylic acid residue, Gln or Leu
  C-term NH2
  Crosslinked Sequence
FXXYWXXL

SEQ ID NO: 35 - protein, 8 aa, Artificial Sequence
  Description of Artificial Sequence: Synthetic peptide
  N-term Ac
  MOD_RES (3)..(3): Any cross-linked amino acid
  MOD_RES (5)..(5): 6-Cl-Trp
  MOD_RES (7)..(7): Any cross-linked amino acid
  C-term NH2
  Crosslinked Sequence
FMXYWEXL

SEQ ID NO: 36 - protein, 9 aa, Artificial Sequence
  Description of Artificial Sequence: Synthetic peptide
  N-term Ac
  MOD_RES (1)..(1): Any cross-linked amino acid
  MOD_RES (4)..(4): 2-aminoisobutyric acid, His or Asn
  MOD_RES (6)..(6): 6-Cl-Trp
  MOD_RES (8)..(8): Any cross-linked amino acid
  C-term NH2
  Crosslinked Sequence
XFMXYWEXL

SEQ ID NO: 37 - protein, 9 aa, Artificial Sequence
  Description of Artificial Sequence: Synthetic peptide
  N-term Ac
  MOD_RES (2)..(2): Any cross-linked amino acid
  MOD_RES (3)..(3): 2-aminoisobutyric acid, His or Asn
  MOD_RES (5)..(5): 6-Cl-Trp
  MOD_RES (7)..(7): Aminocyclopropane carboxylic acid residue, Gln or Leu
  MOD_RES (9)..(9): Any cross-linked amino acid
  C-term NH2
  Crosslinked Sequence
FXXYWEXLX

SEQ ID NO: 38 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
LSQETFADLWKLLAEN

SEQ ID NO: 39 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
LSQETFANLWKLLAQN

SEQ ID NO: 40 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
LSQQTFANLWRLLAQN

SEQ ID NO: 41 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWKLLAQN

SEQ ID NO: 42 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 43 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTAANLWRLLAQN

SEQ ID NO: 44 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QXQQTFANLWRLLAQN

SEQ ID NO: 45 - protein, 16 aa, Artificial Sequence
  Description of Artificial Sequence: Synthetic peptide
  N-term Ac
  C-term NH2
QSQQTFSNLWRLLPQN

SEQ ID NO: 46 - protein, 16 aa, Artificial Sequence
  Description of Artificial Sequence: Synthetic peptide
  N-term Ac
  MOD_RES (7)..(7): Alpha-Me R8-octenyl-alanine olefin amino acids that are not connected by any crosslinker
  MOD_RES (14)..(14): Alpha-Me S5-pentenyl-alanine olefin amino acids that are not connected by any crosslinker
  C-term NH2
QSQQTFANLWRLLAQN

SEQ ID NO: 47 - protein, 16 aa, Artificial Sequence
  Description of Artificial Sequence: Synthetic peptide
  N-term Ac
  MOD_RES (4)..(4): 2-aminoisobutyric acid
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQXTFANLWRLLAQN

SEQ ID NO: 48 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAAN

SEQ ID NO: 49 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
ASQQTFANLWRLLAQN

SEQ ID NO: 50 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFAALWRLLAQN

SEQ ID NO: 51 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQETFANLWRLLAQN

SEQ ID NO: 52 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQTFANLWRLLAQN

SEQ ID NO: 53 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQTFANLWRLLAEN

SEQ ID NO: 54 - protein, 16 aa, Artificial Sequence
  Description of Artificial Sequence: Synthetic peptide
  N-term Ac
  C-term NH2
LSQETFSDLWKLLPEN

SEQ ID NO: 55 - protein, 16 aa, Artificial Sequence
  Description of Artificial Sequence: Synthetic peptide
  N-term Ac
  MOD_RES (4)..(4): Alpha-Me S5-pentenyl-alanine olefin amino acids connected by an all-carbon i to i+4 crosslinker comprising one double bond
  MOD_RES (8)..(8): Alpha-Me S5-pentenyl-alanine olefin amino acids connected by an all-carbon i to i+4 crosslinker comprising one double bond
  C-term NH2
  Crosslinked Sequence
QSQATFSALWRLLPQN

SEQ ID NO: 56 - protein, 16 aa, Artificial Sequence
  Description of Artificial Sequence: Synthetic peptide
  N-term Ac
  MOD_RES (5)..(5): Alpha-Me S5-pentenyl-alanine olefin amino acids connected by an all-carbon i to i+4 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
QSQQAFSNAWRLLPQN

SEQ ID NO: 57 - protein, 16 aa, Artificial Sequence
  Description of Artificial Sequence: Synthetic peptide
  N-term Ac
  MOD_RES (6)..(6): Alpha-Me S5-pentenyl-alanine olefin amino acids connected by an all-carbon i to i+4 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
QSQQTASNLARLLPQN

SEQ ID NO: 58 - protein, 16 aa, Artificial Sequence
  Description of Artificial Sequence: Synthetic peptide
  N-term Ac
  MOD_RES (7)..(7): Alpha-Me S5-pentenyl-alanine olefin amino acids connected by an all-carbon i to i+4 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
QSQQTFANLWALLPQN

SEQ ID NO: 59 - protein, 19 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (11)..(11): 2-aminoisobutyric acid
  MOD_RES (13)..(13): Norleucine
  MOD_RES (14)..(14): Alpha-Me S5-pentenyl-alanine olefin amino acids connected by an all-carbon i to i+4 crosslinker comprising one double bond
  MOD_RES (17)..(17): 2-aminoisobutyric acid
  C-term NH2
  Crosslinked Sequence
RTQATFANQWXALATNXTR

SEQ ID NO: 60 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLARN

SEQ ID NO: 61 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQRTFANLWRLLAQN

SEQ ID NO: 62 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (9)..(9): Norleucine
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 63 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (12)..(12): Norleucine
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 64 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (13)..(13): Norleucine
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 65 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTYANLWRLLAQN

SEQ ID NO: 66 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RXQQTFANLWRLLAQN

SEQ ID NO: 67 - protein, 12 aa, Artificial Sequence
  Description of Artificial Sequence: Synthetic peptide
  N-term Ac
  C-term NH2
MPRFMDYWEGLN

SEQ ID NO: 68 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQRFANLWRLLAQN

SEQ ID NO: 69 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQRFANLWRLLAQN

SEQ ID NO: 70 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RXQQRFANLWRLLAQN

SEQ ID NO: 71 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQRFANFWRLLAQN

SEQ ID NO: 72 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQRFANYWRLLAQN

SEQ ID NO: 73 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQTFANLWQLLAQN

SEQ ID NO: 74 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (12)..(12): Alpha-Me-Leu
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWQLLAQN

SEQ ID NO: 75 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (9)..(9): Alpha-Me-Leu
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 76 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFADYWEGLAQN

SEQ ID NO: 77 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANYWRLLAQN

SEQ ID NO: 78 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
RFANLWRLLAQ

SEQ ID NO: 79 - protein, 15 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (9)..(9): 2-fluoro-Phe
  MOD_RES (13)..(13): Alpha-Me S5-pentenyl-alanine olefin amino acids connected by an all-carbon i to i+4 crosslinker comprising one double bond
  C-term NH2
  Crosslinked Sequence
QSQQTFANWRLLAQN

SEQ ID NO: 80 - protein, 15 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (9)..(9): 3-fluoro-Phe
  MOD_RES (13)..(13): Alpha-Me S5-pentenyl-alanine olefin amino acids connected by an all-carbon i to i+4 crosslinker comprising one double bond
  C-term NH2
  Crosslinked Sequence
QSQQTFANWRLLAQN

SEQ ID NO: 81 - protein, 16 aa, Artificial Sequence
  Description of Artificial Sequence: Synthetic peptide
  N-term Ac
  MOD_RES (7)..(7): Alpha-hydrogen R8-octenyl-alanine olefin amino acid connected by an all-carbon crosslinker comprising one double bond
  MOD_RES (14)..(14): Alpha-hydrogen S5-pentenyl-alanine olefin amino acid connected by an all-carbon crosslinker comprising one double bond
  C-term NH2
  Crosslinked Sequence
QSQQTFANLWRLLAQN

SEQ ID NO: 82 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
RSQQTAANLWRLLAQN

SEQ ID NO: 83 - protein, 16 aa, Artificial Sequence
  Description of Artificial Sequence: Synthetic peptide
  N-term Ac
  MOD_RES (6)..(6): Alpha-methyl R8-octenyl-alanine olefin amino acid connected by an all-carbon crosslinker that is fully saturated
  MOD_RES (13)..(13): Alpha-methyl S5-pentenyl-alanine olefin amino acid connected by an all-carbon crosslinker that is fully saturated
  C-term NH2
  Crosslinked Sequence
QSQQTFANLWRLLAQN

SEQ ID NO: 84 - protein, 16 aa, Artificial Sequence
  Description of Artificial Sequence: Synthetic peptide
  N-term acetylated with heptanoic acid and connected to internal olefin amino acid by an all-carbon crosslinker comprising one double bond
  MOD_RES (4)..(4): Alpha-Me S5-pentenyl-alanine olefin amino acids connected by an all-carbon i to i+4 crosslinker comprising one double bond
  C-term NH2
  Crosslinked Sequence
QSQATFSNLWRLLPQN

SEQ ID NO: 85 - protein, 16 aa, Artificial Sequence
  Description of Artificial Sequence: Synthetic peptide
  N-term acetylated with heptanoic acid and connected to internal olefin amino acid by an all-carbon crosslinker comprising one double bond
  MOD_RES (4)..(4): Alpha-Me S5-pentenyl-alanine olefin amino acids connected by an all-carbon i to i+4 crosslinker comprising one double bond
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQATFANLWRLLAQN

SEQ ID NO: 86 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (10)..(10): 6cl-Trp
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 87 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (10)..(10): Me6cl-D-Trp
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 88 - protein, 12 aa, Artificial Sequence
  Description of Artificial Sequence: Synthetic peptide
  N-term Ac
  C-term NH2
LTFEHYWAQLTS

SEQ ID NO: 89 - protein, 12 aa, Artificial Sequence
  Description of Artificial Sequence: Synthetic peptide
  N-term Ac
  MOD_RES (4)..(4): Alpha-Me S5-pentenyl-alanine olefin amino acids connected by an all-carbon i to i+4 crosslinker comprising one double bond
  MOD_RES (8)..(8): Alpha-Me S5-pentenyl-alanine olefin amino acids connected by an all-carbon i to i+4 crosslinker comprising one double bond
  C-term NH2
  Crosslinked Sequence
LTFAHYWAQLTS

SEQ ID NO: 90 - protein, 12 aa, Artificial Sequence
  Description of Artificial Sequence: Synthetic peptide
  N-term Ac
  MOD_RES (5)..(5): Alpha-Me S5-pentenyl-alanine olefin amino acids connected by an all-carbon i to i+4 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
LTFEAYWAALTS

SEQ ID NO: 91 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker comprising one double bond in cis configuration
  MOD_RES (11)..(11): Alpha-methyl S5-pentenyl-alanine olefin amino acid connected by an all-carbon crosslinker comprising one double bond in cis configuration
  C-term NH2
  Crosslinked Sequence
LTFAHYWAQLAS

SEQ ID NO: 92 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWRQLAS

SEQ ID NO: 93 - protein, 16 aa, Artificial Sequence
  Description of Artificial Sequence: Synthetic peptide
  N-term Ac
  MOD_RES (3)..(3): Alpha-Me S5-pentenyl-alanine olefin amino acids connected by an all-carbon i to i+4 crosslinker comprising one double bond
  MOD_RES (7)..(7): Two Pentyl-alanine olefin amino acid side chain, each of which is crosslinked to another amino acid as indicated
  MOD_RES (14)..(14): Alpha-Me S8-octenyl-alanine olefin amino acids connected by an all-carbon i to i+7 crosslinker comprising one double bond
  C-term NH2
  Crosslinked Sequence
QSAQTFANLWRLLAQN

SEQ ID NO: 94 - protein, 16 aa, Artificial Sequence
  Description of Artificial Sequence: Synthetic peptide
  N-term Ac
  C-term NH2
QSQQTASNLWRLLPQN

SEQ ID NO: 95 - protein, 16 aa, Artificial Sequence
  Description of Artificial Sequence: Synthetic peptide
  N-term Ac
  MOD_RES (7)..(7): Alpha-Me R8-octenyl-alanine olefin amino acids that are not connected by any crosslinker
  MOD_RES (14)..(14): Alpha-Me S5-pentenyl-alanine olefin amino acids that are not connected by any crosslinker
  C-term NH2
QSQQTAANLWRLLAQN

SEQ ID NO: 96 - protein, 16 aa, Artificial Sequence
  Description of Artificial Sequence: Synthetic peptide
  N-term Ac
  MOD_RES (7)..(7): Alpha-Me R8-octenyl-alanine olefin amino acids that are not connected by any crosslinker
  MOD_RES (14)..(14): Alpha-Me S5-pentenyl-alanine olefin amino acids that are not connected by any crosslinker
  C-term NH2
ASQQTFANLWRLLAQN

SEQ ID NO: 97 - protein, 16 aa, Artificial Sequence
  Description of Artificial Sequence: Synthetic peptide
  N-term Ac
  MOD_RES (1)..(1): Alpha-Me S5-pentenyl-alanine olefin amino acids connected by an all-carbon i to i+4 crosslinker comprising one double bond
  MOD_RES (5)..(5): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
ASQQAFSNLWRLLXQN

SEQ ID NO: 98 - protein, 16 aa, Artificial Sequence
  Description of Artificial Sequence: Synthetic peptide
  N-term Ac
  MOD_RES (3)..(3): Alpha-Me S5-pentenyl-alanine olefin amino acids connected by an all-carbon i to i+4 crosslinker comprising one double bond
  MOD_RES (7)..(7): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSAQTFANLWRLLXQN

SEQ ID NO: 99 - protein, 16 aa, Artificial Sequence
  Description of Artificial Sequence: Synthetic peptide
  N-term Ac
  MOD_RES (5)..(5): Alpha-Me S5-pentenyl-alanine olefin amino acids connected by an all-carbon i to i+4 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQQAFSNAWRLLXQN

SEQ ID NO: 100 - protein, 16 aa, Artificial Sequence
  Description of Artificial Sequence: Synthetic peptide
  N-term Ac
  MOD_RES (7)..(7): Alpha-Me S5-pentenyl-alanine olefin amino acids connected by an all-carbon i to i+4 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQQTFANLWALLXQN

SEQ ID NO: 101 - protein, 16 aa, Artificial Sequence
  Description of Artificial Sequence: Synthetic peptide
  N-term Ac
  MOD_RES (8)..(8): Alpha-Me S5-pentenyl-alanine olefin amino acids connected by an all-carbon i to i+4 crosslinker comprising one double bond
  MOD_RES (12)..(12): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQQTFSALWRALXQN

SEQ ID NO: 102 - protein, 16 aa, Artificial Sequence
  Description of Artificial Sequence: Synthetic peptide
  N-term Ac
  MOD_RES (11)..(11): Alpha-Me S5-pentenyl-alanine olefin amino acids connected by an all-carbon i to i+4 crosslinker comprising one double bond
  MOD_RES (15)..(15): Alpha-Me S5-pentenyl-alanine olefin amino acids connected by an all-carbon i to i+4 crosslinker comprising one double bond
  C-term NH2
  Crosslinked Sequence
QSQQTFSNLWALLAAN

SEQ ID NO: 103 - protein, 16 aa, Artificial Sequence
  Description of Artificial Sequence: Synthetic peptide
  N-term Ac
  MOD_RES (1)..(1): Alpha-Me S5-pentenyl-alanine olefin amino acids that are not connected by any crosslinker
  MOD_RES (5)..(5): Alpha-Me S5-pentenyl-alanine olefin amino acids that are not connected by any crosslinker
  MOD_RES (14)..(14): 2-aminoisobutyric acid
  C-term NH2
ASQQAFSNLWRLLXQN

SEQ ID NO: 104 - protein, 16 aa, Artificial Sequence
  Description of Artificial Sequence: Synthetic peptide
  N-term Ac
  MOD_RES (3)..(3): Alpha-Me S5-pentenyl-alanine olefin amino acids that are not connected by any crosslinker
  MOD_RES (7)..(7): Alpha-Me S5-pentenyl-alanine olefin amino acids that are not connected by any crosslinker
  MOD_RES (14)..(14): 2-aminoisobutyric acid
  C-term NH2
QSAQTFANLWRLLXQN

SEQ ID NO: 105 - protein, 16 aa, Artificial Sequence
  Description of Artificial Sequence: Synthetic peptide
  N-term Ac
  MOD_RES (5)..(5): Alpha-Me S5-pentenyl-alanine olefin amino acids that are not connected by any crosslinker
  MOD_RES (9)..(9): Alpha-Me S5-pentenyl-alanine olefin amino acids that are not connected by any crosslinker
  MOD_RES (14)..(14): 2-aminoisobutyric acid
  C-term NH2
QSQQAFSNAWRLLXQN

SEQ ID NO: 106 - protein, 16 aa, Artificial Sequence
  Description of Artificial Sequence: Synthetic peptide
  N-term Ac
  MOD_RES (7)..(7): Alpha-Me S5-pentenyl-alanine olefin amino acids that are not connected by any crosslinker
  MOD_RES (11)..(11): Alpha-Me S5-pentenyl-alanine olefin amino acids that are not connected by any crosslinker
  MOD_RES (14)..(14): 2-aminoisobutyric acid
  C-term NH2
QSQQTFANLWALLXQN

SEQ ID NO: 107 - protein, 16 aa, Artificial Sequence
  Description of Artificial Sequence: Synthetic peptide
  N-term Ac
  MOD_RES (4)..(4): Alpha-Me S5-pentenyl-alanine olefin amino acids connected by an all-carbon i to i+4 crosslinker comprising one double bond
  MOD_RES (8)..(8): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQATFSALWRLLXQN

SEQ ID NO: 108 - protein, 16 aa, Artificial Sequence
  Description of Artificial Sequence: Synthetic peptide
  N-term Ac
  MOD_RES (4)..(4): Alpha-Me S5-pentenyl-alanine olefin amino acids that are not connected by any crosslinker
  MOD_RES (8)..(8): Alpha-Me S5-pentenyl-alanine olefin amino acids that are not connected by any crosslinker
  MOD_RES (14)..(14): 2-aminoisobutyric acid
  C-term NH2
QSQATFSALWRLLXQN

SEQ ID NO: 109 - protein, 16 aa, Artificial Sequence
  Description of Artificial Sequence: Synthetic peptide
  N-term Ac
  MOD_RES (3)..(3): Alpha-Me S5-pentenyl-alanine olefin amino acids that are not connected by any crosslinker
  MOD_RES (7)..(7): Two pentenyl-alanine olefin side chains where one side chain is not crosslinked
  MOD_RES (14)..(14): Alpha-Me S8-octenyl-alanine olefin amino acids that are not connected by any crosslinker
  C-term NH2
QSAQTFANLWRLLAQN

SEQ ID NO: 110 - protein, 16 aa, Artificial Sequence
  Description of Artificial Sequence: Synthetic peptide
  N-term Ac
  MOD_RES (1)..(1): Alpha-Me R8-octenyl-alanine olefin amino acids connected by an all-carbon i to i+7 crosslinker comprising one double bond
  MOD_RES (8)..(8): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
ASQQTFSALWRLLXQN

SEQ ID NO: 111 - protein, 16 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQATFSNLWALLXQN

SEQ ID NO: 112 - protein, 16 aa, Artificial Sequence
  Description of Artificial Sequence: Synthetic peptide
  N-term Ac
  MOD_RES (8)..(8): Alpha-Me R8-octenyl-alanine olefin amino acids connected by an all-carbon i to i+7 crosslinker comprising one double bond
  MOD_RES (15)..(15): Alpha-Me S5-pentenyl-alanine olefin amino acids connected by an all-carbon i to i+4 crosslinker comprising one double bond
  C-term NH2
  Crosslinked Sequence
QSQQTFSALWRLLAAN

SEQ ID NO: 113 - protein, 16 aa, Artificial Sequence
  Description of Artificial Sequence: Synthetic peptide
  N-term Ac
  MOD_RES (3)..(3): Alpha-Me R5-pentenyl-alanine olefin amino acids connected by an all-carbon i to i+4 crosslinker comprising one double bond
  MOD_RES (7)..(7): Two Pentenyl-alanine olefin side chains, each of which is crosslinked to another amino acid as indicated
  MOD_RES (11)..(11): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSAQTFANLWALLXQN

SEQ ID NO: 114 - protein, 16 aa, Artificial Sequence
  Description of Artificial Sequence: Synthetic peptide
  N-term Ac
  MOD_RES (1)..(1): Alpha-Me R8-octenyl-alanine olefin amino acids that are not connected by any crosslinker
  MOD_RES (8)..(8): Alpha-Me S5-pentenyl-alanine olefin amino acids that are not connected by any crosslinker
  MOD_RES (14)..(14): 2-aminoisobutyric acid
  C-term NH2
ASQQTFSALWRLLXQN

SEQ ID NO: 115 - protein, 16 aa, Artificial Sequence
  Description of Artificial Sequence: Synthetic peptide
  N-term Ac
  MOD_RES (4)..(4): Alpha-Me R8-octenyl-alanine olefin amino acids that are not connected by any crosslinker
  MOD_RES (11)..(11): Alpha-Me S5-pentenyl-alanine olefin amino acids that are not connected by any crosslinker
  MOD_RES (14)..(14): 2-aminoisobutyric acid
  C-term NH2
QSQATFSNLWALLXQN

SEQ ID NO: 116 - protein, 16 aa, Artificial Sequence
  Description of Artificial Sequence: Synthetic peptide
  N-term Ac
  MOD_RES (8)..(8): Alpha-Me R8-octenyl-alanine olefin amino acids that are not connected by any crosslinker
  MOD_RES (15)..(15): Alpha-Me S5-pentenyl-alanine olefin amino acids that are not connected by any crosslinker
  C-term NH2
QSQQTFSALWRLLAAN

SEQ ID NO: 117 - protein, 16 aa, Artificial Sequence
  Description of Artificial Sequence: Synthetic peptide
  N-term Ac
  MOD_RES (3)..(3): Alpha-Me R5-pentenyl-alanine olefin amino acids that are not connected by any crosslinker
  MOD_RES (7)..(7): Two pentenyl-alanine olefin side chains where one side chain is not crosslinked
  MOD_RES (11)..(11): Alpha-Me S5-pentenyl-alanine olefin amino acids that are not connected by any crosslinker
  MOD_RES (14)..(14): 2-aminoisobutyric acid
  C-term NH2
QSAQTFANLWALLXQN

SEQ ID NO: 118 - protein, 16 aa, Artificial Sequence
  Description of Artificial Sequence: Synthetic peptide
  N-term Ac
  MOD_RES (14)..(14): 2-aminoisobutyric acid
  C-term NH2
  Crosslinked Sequence
QSQQTFSNLWRLLXQN

SEQ ID NO: 119 - protein, 16 aa, Artificial Sequence
  Description of Artificial Sequence: Synthetic peptide
  N-terminus acetylated with heptanoic acid
  MOD_RES (4)..(4): Alpha-Me S5-pentenyl-alanine olefin amino acids that are not connected by any crosslinker
  MOD_RES (7)..(7): Alpha-Me R8-octenyl-alanine olefin amino acids that are not connected by any crosslinker
  MOD_RES (14)..(14): Alpha-Me S5-pentenyl-alanine olefin amino acids that are not connected by any crosslinker
  C-term NH2
QSQATFANLWRLLAQN

SEQ ID NO: 120 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
ASQQTFANLRWLLAQN

SEQ ID NO: 121 - protein, 15 aa, Artificial Sequence
  Description of Artificial Sequence: Synthetic peptide
  N-term Ac
  MOD_RES (7)..(7): Alpha-Me R8-octenyl-alanine olefin amino acids that are not connected by any crosslinker
  MOD_RES (14)..(14): Alpha-Me S5-pentenyl-alanine olefin amino acids that are not connected by any crosslinker
  C-term NH2
QSQQTFANLWRLLAQ

SEQ ID NO: 122 - protein, 15 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQ

SEQ ID NO: 123 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
AAARAAAAAARAAAAA

SEQ ID NO: 124 - protein, 13 aa, Artificial Sequence
  Description of Artificial Sequence: Synthetic peptide
  N-term Ac
  C-term NH2
LTFEHYWAQLTSA

SEQ ID NO: 125 - protein, 13 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLASA

SEQ ID NO: 126 - protein, 16 aa, Artificial Sequence
  Description of Artificial Sequence: Synthetic peptide
  N-term Ac
  C-term NH2
ASQQTFSNLWRLLPQN

SEQ ID NO: 127 - protein, 16 aa, Artificial Sequence
  Description of Artificial Sequence: Synthetic peptide
  N-term Ac
  MOD_RES (3)..(3): Alpha-Me S5-pentenyl-alanine olefin amino acids connected by an all-carbon i to i+4 crosslinker comprising one double bond
  MOD_RES (7)..(7): Two Pentenyl-alanine olefin side chains, each of which is crosslinked to another amino acid as indicated
  MOD_RES (11)..(11): Alpha-Me R5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSAQTFANLWALLXQN

SEQ ID NO: 128 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): 2-aminoisobutyric acid
  C-term NH2
  Crosslinked Sequence
QSQQTFXNLWRLLXQN

SEQ ID NO: 129 - protein, 16 aa, Artificial Sequence
  Description of Artificial Sequence: Synthetic peptide
  N-term Ac
  MOD_RES (7)..(7): Norleucine
  MOD_RES (14)..(14): Norleucine
  C-term NH2
  Crosslinked Sequence
QSQQTFLNLWRLLLQN

SEQ ID NO: 130 - protein, 16 aa, Artificial Sequence
  Description of Artificial Sequence: Synthetic peptide
  N-term Ac
  MOD_RES (7)..(7): Alpha-Me R8-octenyl-alanine olefin amino acids that are not connected by any crosslinker
  MOD_RES (14)..(14): 2-aminoisobutyric acid
  C-term NH2
QSQQTFANLWRLLXQN

SEQ ID NO: 131 - protein, 16 aa, Artificial Sequence
  Description of Artificial Sequence: Synthetic peptide
  N-term Ac
  MOD_RES (7)..(7): Alpha-Me R8-octenyl-alanine olefin amino acids that are not connected by any crosslinker
  MOD_RES (14)..(14): Norleucine
  C-term NH2
QSQQTFANLWRLLLQN

SEQ ID NO: 132 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): Alpha-Me S5-pentenyl-alanine olefin amino acids that are not connected by any crosslinker
  C-term NH2
QSQQTFXNLWRLLAQN

SEQ ID NO: 133 - protein, 16 aa, Artificial Sequence
  Description of Artificial Sequence: Synthetic peptide
  N-term Ac
  MOD_RES (7)..(7): Norleucine
  MOD_RES (14)..(14): Alpha-Me S5-pentenyl-alanine olefin amino acids that are not connected by any crosslinker
  C-term NH2
QSQQTFLNLWRLLAQN

SEQ ID NO: 134 - protein, 16 aa, Artificial Sequence
  Description of Artificial Sequence: Synthetic peptide
  N-term Ac
  MOD_RES (7)..(7): Alpha-methyl R8-octenyl-alanine olefin amino acid connected by an all-carbon crosslinker that is fully saturated
  MOD_RES (10)..(10): 6cl-Trp
  MOD_RES (12)..(12): Norleucine
  MOD_RES (14)..(14): Alpha-methyl S5-pentenyl-alanine olefin amino acid connected by an all-carbon crosslinker that is fully saturated
  C-term NH2
  Crosslinked Sequence
QSQQTFANLWRLLAQN

SEQ ID NO: 135 - protein, 16 aa, Artificial Sequence
  Description of Artificial Sequence: Synthetic peptide
  N-term Ac
  MOD_RES (7)..(7): Alpha-methyl R8-octenyl-alanine olefin amino acid connected by an all-carbon crosslinker that is fully saturated
  MOD_RES (10)..(10): Me6cl-Trp
  MOD_RES (14)..(14): Alpha-methyl S5-pentenyl-alanine olefin amino acid connected by an all-carbon crosslinker that is fully saturated
  C-term NH2
  Crosslinked Sequence
QSQQTFANLWRLLAQN

SEQ ID NO: 136 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acids connected by an all-carbon i to i+4 crosslinker comprising one double bond
  MOD_RES (7)..(7): Alpha-Me S5-pentenyl-alanine olefin amino acids connected by an all-carbon i to i+4 crosslinker comprising one double bond
  C-term NH2
  Crosslinked Sequence
FLAYWEAL

SEQ ID NO: 137 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWELLAA

SEQ ID NO: 138 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWQLLAA

SEQ ID NO: 139 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANYWELLAQN

SEQ ID NO: 140 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFADYWRLLAQN

SEQ ID NO: 141 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANYWRLLAQ

SEQ ID NO: 142 - protein, 12 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANYWRLLA

SEQ ID NO: 143 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFADLWRLLAQN

SEQ ID NO: 144 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAEN

SEQ ID NO: 145 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQD

SEQ ID NO: 146 - protein, 15 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAS

SEQ ID NO: 147 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
ESQQTFANLWRLLAQN

SEQ ID NO: 148 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANLWRLLAQ

SEQ ID NO: 149 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LRFANLWRLLAQ

SEQ ID NO: 150 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (12)..(12): Norleucine
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANWWRLLAQN

SEQ ID NO: 151 - protein, 15 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (12)..(12): Norleucine
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQ

SEQ ID NO: 152 - protein, 13 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
QTFANLWRLLAQN

SEQ ID NO: 153 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANWWRLLAQN

SEQ ID NO: 154 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANWWRLLAA

SEQ ID NO: 155 - protein, 12 aa, Artificial Sequence
  Description of Artificial Sequence: Synthetic peptide
  N-term Ac
  C-term NH2
TSFAEYWNLLSP

SEQ ID NO: 156 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
QTFAHWWSQLAS

SEQ ID NO: 157 - protein, 8 aa, Artificial Sequence
  Description of Artificial Sequence: Synthetic peptide
  N-term Ac
  MOD_RES (3)..(3): Alpha-Me S5-pentenyl-alanine olefin amino acids connected by an all-carbon i to i+4 crosslinker comprising one double bond
  MOD_RES (7)..(7): Alpha-Me S5-pentenyl-alanine olefin amino acids connected by an all-carbon i to i+4 crosslinker comprising one double bond
  C-term NH2
  Crosslinked Sequence
FMAYWEAL

SEQ ID NO: 158 - protein, 12 aa, Artificial Sequence
  Description of Artificial Sequence: Synthetic peptide
  N-term Ac
  C-term NH2
QTFEHWWSQLLS

SEQ ID NO: 159 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (10)..(10): Alpha-Me-Trp
  MOD_RES (13)..(13): Norleucine
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWRLLAQN

SEQ ID NO: 160 - protein, 8 aa, Artificial Sequence
  Description of Artificial Sequence: Synthetic peptide
  N-term Ac
  MOD_RES (3)..(3): 2-aminoisobutyric acid
  MOD_RES (5)..(5): 6cl-Trp
  MOD_RES (7)..(7): Aminocyclopropane carboxylic acid residue
  C-term NH2
  Crosslinked Sequence
FMXYWEXL

SEQ ID NO: 161 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acids connected by an all-carbon i to i+4 crosslinker comprising one double bond
  MOD_RES (5)..(5): 6cl-Trp
  MOD_RES (7)..(7): Alpha-Me S5-pentenyl-alanine olefin amino acids connected by an all-carbon i to i+4 crosslinker comprising one double bond
  C-term NH2
  Crosslinked Sequence
FLAYWEAL

SEQ ID NO: 162 - protein, 9 aa, Artificial Sequence
  Description of Artificial Sequence: Synthetic peptide
  N-term Ac
  MOD_RES (2)..(2): Alpha-methyl R8-octenyl-alanine olefin amino acid connected by an all-carbon crosslinker comprising one double bond in cis configuration
  MOD_RES (5)..(5): 6cl-Trp
  MOD_RES (7)..(7): Aminocyclopropane carboxylic acid residue
  MOD_RES (9)..(9): Alpha-methyl S5-pentenyl-alanine olefin amino acid connected by an all-carbon crosslinker comprising one double bond in cis configuration
  C-term NH2
  Crosslinked Sequence
FAAYWEXLA

SEQ ID NO: 163 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 164 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acids connected by an all-carbon i to i+7 crosslinker comprising one double bond
  MOD_RES (8)..(8): 6cl-Trp
  MOD_RES (12)..(12): Alpha-Me S5-pentenyl-alanine olefin amino acids connected by an all-carbon i to i+4 crosslinker comprising one double bond
  C-term NH2
  Crosslinked Sequence
LPRFANYWRLLAQN

SEQ ID NO: 165 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
AFAAAWALAAA

SEQ ID NO: 166 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWRLAAQ

SEQ ID NO: 167 - protein, 11 aa, Artificial Sequence
  Description of Artificial Sequence: Synthetic peptide
  N-term Pr
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWRLAAQ

SEQ ID NO: 168 - protein, 16 aa, Artificial Sequence
  Description of Artificial Sequence: Synthetic peptide
  N-term Ac
  MOD_RES (7)..(7): Alpha-methyl R8-octenyl-alanine olefin amino acid connected by an all-carbon crosslinker that is fully saturated
  MOD_RES (12)..(12): Norleucine
  MOD_RES (14)..(14): Alpha-methyl S5-pentenyl-alanine olefin amino acid connected by an all-carbon crosslinker that is fully saturated
  C-term NH2
  Crosslinked Sequence
QSQQTFANLWRLLAQN

SEQ ID NO: 169 - protein, 13 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
LTFAHYWAQLASA

SEQ ID NO: 170 - protein, 14 aa, Artificial Sequence
  Description of Artificial Sequence: Synthetic peptide
  N-term Ac
  MOD_RES (1)..(1): Norleucine
  MOD_RES (5)..(5): Alpha-methyl R8-octenyl-alanine olefin amino acid connected by an all-carbon crosslinker that is fully saturated
  MOD_RES (12)..(12): Alpha-methyl S5-pentenyl-alanine olefin amino acid connected by an all-carbon crosslinker that is fully saturated
  C-term NH2
  Crosslinked Sequence
LPRFANYWRLLAQN

SEQ ID NO: 171 - protein, 14 aa, Artificial Sequence
  Description of Artificial Sequence: Synthetic peptide
  N-term Ac
  MOD_RES (1)..(1): Norleucine
  MOD_RES (5)..(5): Alpha-methyl R8-octenyl-alanine olefin amino acid connected by an all-carbon crosslinker that is fully saturated
  MOD_RES (8)..(8): 6cl-Trp
  MOD_RES (12)..(12): Alpha-methyl S5-pentenyl-alanine olefin amino acid connected by an all-carbon crosslinker that is fully saturated
  C-term NH2
  Crosslinked Sequence
LPRFANYWRLLAQN

SEQ ID NO: 172 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (7)..(7): 6cl-Trp
  MOD_RES (11)..(11): Alpha-methyl S5-pentenyl-alanine olefin amino acid connected by an all-carbon crosslinker that is fully saturated
  C-term NH2
  Crosslinked Sequence
LTFAHYWAQLAS

SEQ ID NO: 173 - protein, 16 aa, Artificial Sequence
  Description of Artificial Sequence: Synthetic peptide
  N-term Ac
  MOD_RES (3)..(3): Alpha-methyl S5-pentenyl-alanine olefin amino acid connected by an all-carbon crosslinker that is fully saturated
  MOD_RES (7)..(7): Two pentenyl-alanine olefin side chains, each of which is crosslinked to another amino acid as indicated via fully saturated hydrocarbon crosslinks
  MOD_RES (14)..(14): Alpha-methyl S8-octenyl-alanine olefin amino acid connected by an all-carbon crosslinker that is fully saturated
  C-term NH2
  Crosslinked Sequence
QSAQTFANLWRLLAQN

SEQ ID NO: 174 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (7)..(7): 6cl-Trp
  MOD_RES (11)..(11): Alpha-methyl S5-pentenyl-alanine olefin amino acid connected by an all-carbon crosslinker that is fully saturated
  C-term NH2
  Crosslinked Sequence
LTFAHYWRQLAS

SEQ ID NO: 175 - protein, 16 aa, Artificial Sequence
  Description of Artificial Sequence: Synthetic peptide
  N-term Ac
  MOD_RES (7)..(7): Alpha-methyl R8-octenyl-alanine olefin amino acid connected by an all-carbon crosslinker that is fully saturated
  MOD_RES (10)..(10): 6cl-Trp
  MOD_RES (14)..(14): Alpha-methyl S5-pentenyl-alanine olefin amino acid connected by an all-carbon crosslinker that is fully saturated
  C-term NH2
  Crosslinked Sequence
QSQQTFANLWRLLAQN

SEQ ID NO: 176 - protein, 16 aa, Artificial Sequence
  Description of Artificial Sequence: Synthetic peptide
  N-term Ac
  MOD_RES (1)..(1): Alpha-methyl R8-octenyl-alanine olefin amino acid connected by an all-carbon crosslinker that is fully saturated
  MOD_RES (8)..(8): Alpha-methyl S5-pentenyl-alanine olefin amino acid connected by an all-carbon crosslinker that is fully saturated
  MOD_RES (14)..(14): 2-aminoisobutyric acid
  C-term NH2
  Crosslinked Sequence
ASQQTFSALWRLLXQN

SEQ ID NO: 177 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
LTFAHYWAQLAS

SEQ ID NO: 178 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
TSFAQYWNLLAP

SEQ ID NO: 179 - protein, 12 aa, Artificial Sequence
  Description of Artificial Sequence: Synthetic peptide
  N-term Ac
  C-term NH2
LTFEHYWAQLTS

SEQ ID NO: 180 - protein, 9 aa, Artificial Sequence
  Description of Artificial Sequence: Synthetic peptide
  N-term Ac
  MOD_RES (2)..(2): Alpha-methyl R8-octenyl-alanine olefin amino acid connected by an all-carbon crosslinker comprising one double bond in trans configuration
  MOD_RES (5)..(5): 6cl-Trp
  MOD_RES (7)..(7): Aminocyclopropane carboxylic acid residue
  MOD_RES (9)..(9): Alpha-methyl S5-pentenyl-alanine olefin amino acid connected by an all-carbon crosslinker comprising one double bond in trans configuration
  C-term NH2
  Crosslinked Sequence
FAAYWEXLA

SEQ ID NO: 181 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
AFAAAWALAAA

SEQ ID NO: 182 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWRLAAQ

SEQ ID NO: 183 - protein, 11 aa, Artificial Sequence
  Description of Artificial Sequence: Synthetic peptide
  N-term Pr
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWRLAAQ

SEQ ID NO: 184 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker comprising one double bond in trans configuration
  MOD_RES (11)..(11): Alpha-methyl S5-pentenyl-alanine olefin amino acid connected by an all-carbon crosslinker comprising one double bond in trans configuration
  C-term NH2
  Crosslinked Sequence
LTFAHYWAQLAS

SEQ ID NO: 185 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acids connected by an all-carbon i to i+7 crosslinker comprising one double bond
  MOD_RES (21)..(21): Alpha-Me S5-pentenyl-alanine olefin amino acids connected by an all-carbon i to i+4 crosslinker comprising one double bond
  C-term NH2
  Crosslinked Sequence
CCPGCCAQSQQTFANLWRLLAQN

SEQ ID NO: 186 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acids connected by an all-carbon i to i+7 crosslinker comprising one double bond
  MOD_RES (21)..(21): Alpha-Me S5-pentenyl-alanine olefin amino acids connected by an all-carbon i to i+4 crosslinker comprising one double bond
  C-term NH2
  Crosslinked Sequence
CCPGCCAQSQQTAANLWRLLAQN

SEQ ID NO: 187 - protein, 21 aa, Artificial Sequence
  Description of Artificial Sequence: Synthetic peptide
  N-term Ac
  MOD_RES (7)..(7): Beta-Ala
  MOD_RES (8)..(8): Norleucine
  MOD_RES (12)..(12): Alpha-Me R8-octenyl-alanine olefin amino acids connected by an all-carbon i to i+7 crosslinker comprising one double bond
  MOD_RES (19)..(19): Alpha-Me S5-pentenyl-alanine olefin amino acids connected by an all-carbon i to i+4 crosslinker comprising one double bond
  C-term NH2
  Crosslinked Sequence
CCPGCCALPRFANYWRLLAQN

SEQ ID NO: 188 - protein, 12 aa, Artificial Sequence
  Description of Artificial Sequence: Synthetic peptide
  N-term Ac
  MOD_RES (4)..(4): Alpha-Me R8-octenyl-alanine olefin amino acids that are not connected by any crosslinker
  MOD_RES (11)..(11): Alpha-Me S5-pentenyl-alanine olefin amino acids that are not connected by any crosslinker
  C-term NH2
LTFAHYWAQLAS

SEQ ID NO: 189 - protein, 9 aa, Artificial Sequence
  Description of Artificial Sequence: Synthetic peptide
  N-term Ac
  MOD_RES (2)..(2): Alpha-methyl R8-octenyl-alanine olefin amino acid connected by an all-carbon crosslinker that is fully saturated
  MOD_RES (5)..(5): 6cl-Trp
  MOD_RES (7)..(7): Aminocyclopropane carboxylic acid residue
  MOD_RES (9)..(9): Alpha-methyl S5-pentenyl-alanine olefin amino acid connected by an all-carbon crosslinker that is fully saturated
  C-term NH2
  Crosslinked Sequence
FAHYWRXLA

SEQ ID NO: 190 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
QTFAHWWSQLAS

SEQ ID NO: 191 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWRQLAS

SEQ ID NO: 192 - protein, 16 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QAQQTFSNAWRLLXQN

SEQ ID NO: 193 - protein, 16 aa, Artificial Sequence
  Description of Artificial Sequence: Synthetic peptide
  N-term Ac
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQQAFSNLWRALXQN

SEQ ID NO: 194 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 195 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAS

SEQ ID NO: 196 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAQ

SEQ ID NO: 197 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): 2-aminoisobutyric acid
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAS

SEQ ID NO: 198 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAS

SEQ ID NO: 199 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEQLAS

SEQ ID NO: 200 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHYWEQLAS

SEQ ID NO: 201 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHYWAQLAS

SEQ ID NO: 202 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHYWAXLAS

SEQ ID NO: 203 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHYWRXLAS

SEQ ID NO: 204 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-hydrogen S5-pentenyl-alanine olefin amino acid connected by an all-carbon crosslinker comprising one double bond
  C-term NH2
  Crosslinked Sequence
FAAYWEXLAA

SEQ ID NO: 205 - protein, 14 aa, Artificial Sequence
  Description of Artificial Sequence: Synthetic peptide
  N-term Ac
  MOD_RES (1)..(1): Norleucine
  MOD_RES (5)..(5): Alpha-methyl R8-octenyl-alanine olefin amino acid connected by an all-carbon crosslinker that is fully saturated
  MOD_RES (12)..(12): Alpha-methyl S5-pentenyl-alanine olefin amino acid connected by an all-carbon crosslinker that is fully saturated
  C-term NH2
  Crosslinked Sequence
LPTFXNYWRLLAQN

SEQ ID NO: 206 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWRALAQ

SEQ ID NO: 207 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
TSFXHYWAQLAS

SEQ ID NO: 208 - protein, 10 aa, Artificial Sequence
  Description of Artificial Sequence: Synthetic peptide
  N-term Ac
  MOD_RES (2)..(2): Alpha-methyl R8-octenyl-alanine olefin amino acid connected by an all-carbon crosslinker that is fully saturated
  MOD_RES (5)..(5): 6cl-Trp
  MOD_RES (7)..(7): Aminocyclopropane carboxylic acid residue
  MOD_RES (9)..(9): Alpha-methyl S5-pentenyl-alanine olefin amino acid connected by an all-carbon crosslinker that is fully saturated
  C-term NH2
  Crosslinked Sequence
FAAYWEXLAA

SEQ ID NO: 209 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQIAS

SEQ ID NO: 210 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 211 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAA

SEQ ID NO: 212 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (12)..(12): Abu
  C-term NH2
  Crosslinked Sequence
LTFAHYWAQLAX

SEQ ID NO: 213 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Abu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWXQLAS

SEQ ID NO: 214 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker comprising one double bond in trans configuration
  MOD_RES (11)..(11): Alpha-methyl S5-pentenyl-alanine olefin amino acid connected by an all-carbon crosslinker comprising one double bond in trans configuration
  C-term NH2
  Crosslinked Sequence
LTFAAYWAQLAS

SEQ ID NO: 215 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAHYWAQLAS

SEQ ID NO: 216 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAAYWAQLAS

SEQ ID NO: 217 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker comprising one double bond in trans configuration
  MOD_RES (11)..(11): Alpha-methyl S5-pentenyl-alanine olefin amino acid connected by an all-carbon crosslinker comprising one double bond in trans configuration
  C-term NH2
  Crosslinked Sequence
LTFAAYWAQLAA

SEQ ID NO: 218 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAAYWAQLAA

SEQ ID NO: 219 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANLWALLAQ

SEQ ID NO: 220 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANLWALLAA

SEQ ID NO: 221 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAALWALLAQ

SEQ ID NO: 222 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFANLWALLAQ

SEQ ID NO: 223 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAALWALLAA

SEQ ID NO: 224 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
AAAYWEXLAA

SEQ ID NO: 225 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAA

SEQ ID NO: 226 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEXLAX

SEQ ID NO: 227 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (10)..(10): Norleucine
  C-term NH2
  Crosslinked Sequence
FAAYWEXLAL

SEQ ID NO: 228 - protein, 10 aa, Artificial Sequence
  Description of Artificial Sequence: Synthetic peptide
  N-term Ac
  MOD_RES (2)..(2): Alpha-Me R5-pentenyl-alanine olefin amino acids connected by an all-carbon i to i+4 crosslinker comprising one double bond
  MOD_RES (7)..(7): Aminocyclopropane carboxylic acid residue
  MOD_RES (9)..(9): Alpha-Me S8-octenyl-alanine olefin amino acids connected by an all-carbon i to i+7 crosslinker comprising one double bond
  C-term NH2
  Crosslinked Sequence
FAAYWEXLAA

SEQ ID NO: 229 - protein, 10 aa, Artificial Sequence
  Description of Artificial Sequence: Synthetic peptide
  N-term Ac
  MOD_RES (2)..(2): Alpha-Me S5-pentenyl-alanine olefin amino acids connected by an all-carbon i to i+4 crosslinker comprising one double bond
  MOD_RES (7)..(7): Aminocyclopropane carboxylic acid residue
  MOD_RES (9)..(9): Alpha-Me R8-octenyl-alanine olefin amino acids connected by an all-carbon i to i+7 crosslinker comprising one double bond
  C-term NH2
  Crosslinked Sequence
FAAYWEXLAA

SEQ ID NO: 230 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXIAA

SEQ ID NO: 231 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 232 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Alpha-Me-Leu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWELLAA

SEQ ID NO: 233 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWELLAA

SEQ ID NO: 234 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWQXLAA

SEQ ID NO: 235 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAXLAA

SEQ ID NO: 236 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Abu
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWXXLAA

SEQ ID NO: 237 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Norleucine
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWLXLAA

SEQ ID NO: 238 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (3)..(3): Abu
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAXYWEXLAA

SEQ ID NO: 239 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (3)..(3): Norleucine
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FALYWEXLAA

SEQ ID NO: 240 - protein, 13 aa, Artificial Sequence
  Description of Artificial Sequence: Synthetic peptide
  N-term 5-FAM
  MOD_RES (1)..(1): Beta-Ala
  C-term NH2
  Crosslinked Sequence
ALTFEHYWAQLTS

SEQ ID NO: 241 - protein, 13 aa, Artificial Sequence
  Description of Artificial Sequence: Synthetic peptide
  N-term 5-FAM
  MOD_RES (1)..(1): Beta-Ala
  MOD_RES (5)..(5): Alpha-methyl R8-octenyl-alanine olefin amino acid connected by an all-carbon crosslinker that is fully saturated
  MOD_RES (12)..(12): Alpha-methyl S5-pentenyl-alanine olefin amino acid connected by an all-carbon crosslinker that is fully saturated
  C-term NH2
  Crosslinked Sequence
ALTFAHYWAQLAS

SEQ ID NO: 242 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 243 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Tert-butyl-Gly
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 244 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Adamantyl-Gly
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 245 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Homo-Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQAAS

SEQ ID NO: 246 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQAAS

SEQ ID NO: 247 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Aminocyclohexane carboxylic acid residue
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWXQLAS

SEQ ID NO: 248 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Aminocyclopentane carboxylic acid residue
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWXQLAS

SEQ ID NO: 249 - protein, 12 aa, Artificial Sequence
  Description of Artificial Sequence: Synthetic peptide
  N-term Ac
  MOD_RES (3)..(3): Homo-Phe
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 250 - protein, 12 aa, Artificial Sequence
  Description of Artificial Sequence: Synthetic peptide
  N-term Ac
  MOD_RES (3)..(3): Indanyl-Gly
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTGAHYWAQLAS

SEQ ID NO: 251 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 252 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQFAS

SEQ ID NO: 253 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Indanyl-Gly
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 254 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQAAS

SEQ ID NO: 255 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclopentylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 256 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Homo-Tyr
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 257 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Homo-Leu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 258 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Tert-butyl-Gly
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXGAA

SEQ ID NO: 259 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Adamantyl-Gly
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXGAA

SEQ ID NO: 260 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Homo-Cyclohexylalanine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXAAA

SEQ ID NO: 261 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Cyclohexylalanine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXAAA

SEQ ID NO: 262 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclohexane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 263 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopentane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 264 - protein, 10 aa, Artificial Sequence
  Description of Artificial Sequence: Synthetic peptide
  N-term Ac
  MOD_RES (1)..(1): Homo-Phe
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 265 - protein, 10 aa, Artificial Sequence
  Description of Artificial Sequence: Synthetic peptide
  N-term Ac
  MOD_RES (1)..(1): Indanyl-Gly
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
GAAYWEXLAA

SEQ ID NO: 266 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXFAA

SEQ ID NO: 267 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Indanyl-Gly
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXGAA

SEQ ID NO: 268 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Cyclobutyl-Ala
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXAAA

SEQ ID NO: 269 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (8)..(8): Cyclopentylglycine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXGAA

SEQ ID NO: 270 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (4)..(4): Homo-Tyr
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 271 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAQ

SEQ ID NO: 272 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): 2-aminoisobutyric acid
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAA

SEQ ID NO: 273 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 274 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAAYWAALAA

SEQ ID NO: 275 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Aminocyclopropane carboxylic acid residue
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAXLAS

SEQ ID NO: 276 - protein, 12 aa, Artificial Sequence
  Description of Artificial Sequence: Synthetic peptide
  N-term Ac
  MOD_RES (1)..(1): Norleucine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 277 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
VTFAHYWAQLAS

SEQ ID NO: 278 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAHYWAQLAS

SEQ ID NO: 279 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAHYWAQLAS

SEQ ID NO: 280 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
RTFAHYWAQLAS

SEQ ID NO: 281 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
KTFAHYWAQLAS

SEQ ID NO: 282 - protein, 12 aa, Artificial Sequence
  Description of Artificial Sequence: Synthetic peptide
  N-term Ac
  MOD_RES (2)..(2): Norleucine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LLFAHYWAQLAS

SEQ ID NO: 283 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LVFAHYWAQLAS

SEQ ID NO: 284 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LFFAHYWAQLAS

SEQ ID NO: 285 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LWFAHYWAQLAS

SEQ ID NO: 286 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LRFAHYWAQLAS

SEQ ID NO: 287 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LKFAHYWAQLAS

SEQ ID NO: 288 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFALYWAQLAS

SEQ ID NO: 289 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAVYWAQLAS

SEQ ID NO: 290 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAFYWAQLAS

SEQ ID NO: 291 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAWYWAQLAS

SEQ ID NO: 292 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFARYWAQLAS

SEQ ID NO: 293 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAKYWAQLAS

SEQ ID NO: 294 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHLWAQLAS

SEQ ID NO: 295 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHVWAQLAS

SEQ ID NO: 296 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 297 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHWWAQLAS

SEQ ID NO: 298 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHRWAQLAS

SEQ ID NO: 299 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHKWAQLAS

SEQ ID NO: 300 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWLQLAS

SEQ ID NO: 301 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWVQLAS

SEQ ID NO: 302 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWFQLAS

SEQ ID NO: 303 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWWQLAS

SEQ ID NO: 304 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWKQLAS

SEQ ID NO: 305 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWALLAS

SEQ ID NO: 306 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAVLAS

SEQ ID NO: 307 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAFLAS

SEQ ID NO: 308 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAWLAS

SEQ ID NO: 309 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWARLAS

SEQ ID NO: 310 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (12)..(12): Norleucine
  C-term NH2
  Crosslinked Sequence
LTFAHYWAQLAL

SEQ ID NO: 311 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAV

SEQ ID NO: 312 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAF

SEQ ID NO: 313 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAW

SEQ ID NO: 314 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAR

SEQ ID NO: 315 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAK

SEQ ID NO: 316 - protein, 16 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QAQQTFSNAWRLLXQN

SEQ ID NO: 317 - protein, 16 aa, Artificial Sequence
  Description of Artificial Sequence: Synthetic peptide
  N-term Ac
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  MOD_RES (14)..(14): 2-aminoisobutyric acid
  C-term NH2
  Crosslinked Sequence
QSQQAFSNLWRALXQN

SEQ ID NO: 318 - protein, 12 aa, Artificial Sequence
  Description of Artificial Sequence: Synthetic peptide
  N-term Ac
  MOD_RES (3)..(3): 2-Pyridylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWAQLAS

SEQ ID NO: 319 - protein, 12 aa, Artificial Sequence
  Description of Artificial Sequence: Synthetic peptide
  N-term Ac
  MOD_RES (3)..(3): 3-Pyridylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWAQLAS

SEQ ID NO: 320 - protein, 12 aa, Artificial Sequence
  Description of Artificial Sequence: Synthetic peptide
  N-term Ac
  MOD_RES (3)..(3): 4-Pyridylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWAQLAS

SEQ ID NO: 321 - protein, 12 aa, Artificial Sequence
  Description of Artificial Sequence: Synthetic peptide
  N-term Ac
  MOD_RES (3)..(3): Phe-2CF3
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 322 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 323 - protein, 12 aa, Artificial Sequence
  Description of Artificial Sequence: Synthetic peptide
  N-term Ac
  MOD_RES (3)..(3): Phe-2Me
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 324 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 325 - protein, 12 aa, Artificial Sequence
  Description of Artificial Sequence: Synthetic peptide
  N-term Ac
  MOD_RES (3)..(3): Phe-4CF3
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 326 - protein, 12 aa, Artificial Sequence
  Description of Artificial Sequence: Synthetic peptide
  N-term Ac
  MOD_RES (3)..(3): Phe-4tBu
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 327 - protein, 12 aa, Artificial Sequence
  Description of Artificial Sequence: Synthetic peptide
  N-term Ac
  MOD_RES (3)..(3): Phe-5F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 328 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (7)..(7): 3Bth-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYAAQLAS

SEQ ID NO: 329 - protein, 12 aa, Artificial Sequence
  Description of Artificial Sequence: Synthetic peptide
  N-term Ac
  MOD_RES (3)..(3): Phe-2Br
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 330 - protein, 12 aa, Artificial Sequence
  Description of Artificial Sequence: Synthetic peptide
  N-term Ac
  MOD_RES (3)..(3): Phe-4Br
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 331 - protein, 12 aa, Artificial Sequence
  Description of Artificial Sequence: Synthetic peptide
  N-term Ac
  MOD_RES (3)..(3): Phe-2Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 332 - protein, 12 aa, Artificial Sequence
  Description of Artificial Sequence: Synthetic peptide
  N-term Ac
  MOD_RES (3)..(3): Phe-4Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 333 - protein, 12 aa, Artificial Sequence
  Description of Artificial Sequence: Synthetic peptide
  N-term Ac
  MOD_RES (3)..(3): Phe-3CN
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 334 - protein, 12 aa, Artificial Sequence
  Description of Artificial Sequence: Synthetic peptide
  N-term Ac
  MOD_RES (3)..(3): Phe-4CN
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 335 - protein, 12 aa, Artificial Sequence
  Description of Artificial Sequence: Synthetic peptide
  N-term Ac
  MOD_RES (3)..(3): Phe-34Cl2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 336 - protein, 12 aa, Artificial Sequence
  Description of Artificial Sequence: Synthetic peptide
  N-term Ac
  MOD_RES (3)..(3): Phe-34F2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 337 - protein, 12 aa, Artificial Sequence
  Description of Artificial Sequence: Synthetic peptide
  N-term Ac
  MOD_RES (3)..(3): Phe-35F2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 338 - protein, 12 aa, Artificial Sequence
  Description of Artificial Sequence: Synthetic peptide
  N-term Ac
  MOD_RES (3)..(3): 3,3-diphenyl-Ala
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 339 - protein, 12 aa, Artificial Sequence
  Description of Artificial Sequence: Synthetic peptide
  N-term Ac
  MOD_RES (3)..(3): Phe-2F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 340 - protein, 12 aa, Artificial Sequence
  Description of Artificial Sequence: Synthetic peptide
  N-term Ac
  MOD_RES (3)..(3): Phe-3F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 341 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 342 - protein, 12 aa, Artificial Sequence
  Description of Artificial Sequence: Synthetic peptide
  N-term Ac
  MOD_RES (3)..(3): Phe-4I
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 343 - protein, 12 aa, Artificial Sequence
  Description of Artificial Sequence: Synthetic peptide
  N-term Ac
  MOD_RES (3)..(3): Phe-3Me
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 344 - protein, 12 aa, Artificial Sequence
  Description of Artificial Sequence: Synthetic peptide
  N-term Ac
  MOD_RES (3)..(3): Phe-4Me
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 345 - protein, 12 aa, Artificial Sequence
  Description of Artificial Sequence: Synthetic peptide
  N-term Ac
  MOD_RES (3)..(3): 1-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWAQLAS

SEQ ID NO: 346 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWAQLAS

SEQ ID NO: 347 - protein, 12 aa, Artificial Sequence
  Description of Artificial Sequence: Synthetic peptide
  N-term Ac
  MOD_RES (3)..(3): Phe-3CF3
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 348 - protein, 12 aa, Artificial Sequence
  Description of Artificial Sequence: Synthetic peptide
  N-term Ac
  MOD_RES (3)..(3): Phe-4NO2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 349 - protein, 12 aa, Artificial Sequence
  Description of Artificial Sequence: Synthetic peptide
  N-term Ac
  MOD_RES (3)..(3): Phe-3NO2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 350 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): 2Thi
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 351 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Biphenylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 352 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4tBu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 353 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4CF3
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 354 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4Cl
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 355 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4Me
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 356 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4Br
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 357 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4CN
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 358 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): Phe-4NO2
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHFWAQLAS

SEQ ID NO: 359 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): 1-Naphthylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHAWAQLAS

SEQ ID NO: 360 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): 2-Naphthylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHAWAQLAS

SEQ ID NO: 361 - protein, 11 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
LTFAHWAQLAS

SEQ ID NO: 362 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (7)..(7): 1-Naphthylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYAAQLAS

SEQ ID NO: 363 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (7)..(7): 2-Naphthylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYAAQLAS

SEQ ID NO: 364 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQIAS

SEQ ID NO: 365 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 366 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker comprising one double bond in trans configuration
  MOD_RES (11)..(11): Alpha-methyl S5-pentenyl-alanine olefin amino acid connected by an all-carbon crosslinker comprising one double bond in trans configuration
  C-term NH2
  Crosslinked Sequence
LTFAHYWAQLAA

SEQ ID NO: 367 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (12)..(12): Abu
  C-term NH2
  Crosslinked Sequence
LTFAHYWAQLAX

SEQ ID NO: 368 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Abu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWXQLAS

SEQ ID NO: 369 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAHYWAQLAS

SEQ ID NO: 370 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANLWALLAQ

SEQ ID NO: 371 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAALWALLAQ

SEQ ID NO: 372 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFANLWALLAQ

SEQ ID NO: 373 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAXLAA

SEQ ID NO: 374 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAALAS

SEQ ID NO: 375 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LVFAAYWAQLAS

SEQ ID NO: 376 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Abu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWXQLAS

SEQ ID NO: 377 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWLQLAS

SEQ ID NO: 378 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): Abu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAXYWAQLAS

SEQ ID NO: 379 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWHQLAS

SEQ ID NO: 380 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWKQLAS

SEQ ID NO: 381 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): Ornithine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWXQLAS

SEQ ID NO: 382 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWRQLAS

SEQ ID NO: 383 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWSQLAS

SEQ ID NO: 384 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWRALAS

SEQ ID NO: 385 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWRQLAA

SEQ ID NO: 386 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWRALAA

SEQ ID NO: 387 - protein, 12 aa, Artificial Sequence
  Description of Artificial Sequence: Synthetic peptide
  N-term Ac
  MOD_RES (4)..(4): Alpha-Me R5-pentenyl-alanine olefin amino acids connected by an all-carbon i to i+4 crosslinker comprising one double bond
  MOD_RES (11)..(11): Alpha-Me S8-octenyl-alanine olefin amino acids connected by an all-carbon i to i+7 crosslinker comprising one double bond
  C-term NH2
  Crosslinked Sequence
LTFAHYWAQLAS

SEQ ID NO: 388 - protein, 12 aa, Artificial Sequence
  Description of Artificial Sequence: Synthetic peptide
  N-term Ac
  MOD_RES (4)..(4): Alpha-Me S5-pentenyl-alanine olefin amino acids connected by an all-carbon i to i+4 crosslinker comprising one double bond
  MOD_RES (11)..(11): Alpha-Me R8-octenyl-alanine olefin amino acids connected by an all-carbon i to i+7 crosslinker comprising one double bond
  C-term NH2
  Crosslinked Sequence
LTFAHYWAQLAS

SEQ ID NO: 389 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAALAS

SEQ ID NO: 390 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Abu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAXLAS

SEQ ID NO: 391 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWALLAS

SEQ ID NO: 392 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWHALAA

SEQ ID NO: 393 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAALAA

SEQ ID NO: 394 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWSALAA

SEQ ID NO: 395 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWRALAA

SEQ ID NO: 396 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWKALAA

SEQ ID NO: 397 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Ornithine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWXALAA

SEQ ID NO: 398 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAVYWEXLAA

SEQ ID NO: 399 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAFYWEXLAA

SEQ ID NO: 400 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAWYWEXLAA

SEQ ID NO: 401 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FARYWEXLAA

SEQ ID NO: 402 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAKYWEXLAA

SEQ ID NO: 403 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (4)..(4): Norleucine
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAALWEXLAA

SEQ ID NO: 404 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAVWEXLAA

SEQ ID NO: 405 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAFWEXLAA

SEQ ID NO: 406 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWEXLAA

SEQ ID NO: 407 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAARWEXLAA

SEQ ID NO: 408 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAKWEXLAA

SEQ ID NO: 409 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWVXLAA

SEQ ID NO: 410 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWFXLAA

SEQ ID NO: 411 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWWXLAA

SEQ ID NO: 412 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWRXLAA

SEQ ID NO: 413 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWKXLAA

SEQ ID NO: 414 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEVLAA

SEQ ID NO: 415 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEFLAA

SEQ ID NO: 416 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEWLAA

SEQ ID NO: 417 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWERLAA

SEQ ID NO: 418 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEKLAA

SEQ ID NO: 419 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAV

SEQ ID NO: 420 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAF

SEQ ID NO: 421 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAW

SEQ ID NO: 422 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAR

SEQ ID NO: 423 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAK

SEQ ID NO: 424 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAV

SEQ ID NO: 425 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAF

SEQ ID NO: 426 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAW

SEQ ID NO: 427 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAR

SEQ ID NO: 428 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAK

SEQ ID NO: 429 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAH

SEQ ID NO: 430 - protein, 12 aa, Artificial Sequence
  Description of Artificial Sequence: Synthetic peptide
  N-term Ac
  MOD_RES (3)..(3): Phe-2NO2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 431 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYAAQLAS

SEQ ID NO: 432 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYAAQLAS

SEQ ID NO: 433 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QSQQTFANLWALLAAN

SEQ ID NO: 434 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QXQQTFANLWALLAAN

SEQ ID NO: 435 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
QXQQTFAALWALLAAN

SEQ ID NO: 436 - protein, 16 aa, Artificial Sequence
  Description of Artificial Sequence: Synthetic peptide
  N-term Ac
  MOD_RES (7)..(7): Alpha-Me R8-octenyl-alanine olefin amino acids connected by an all-carbon i to i+7 crosslinker comprising one double bond
  MOD_RES (14)..(14): Alpha-Me S5-pentenyl-alanine olefin amino acids connected by an all-carbon i to i+4 crosslinker comprising one double bond
  C-term NH2
  Crosslinked Sequence
AAAATFAAAWAALAAA

SEQ ID NO: 437 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAAWRALAQ

SEQ ID NO: 438 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWAALAQ

SEQ ID NO: 439 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWRALAA

SEQ ID NO: 440 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
VFAAAWRALAQ

SEQ ID NO: 441 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
AFAAAWAALAA

SEQ ID NO: 442 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWKALAQ

SEQ ID NO: 443 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (7)..(7): Ornithine
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWXALAQ

SEQ ID NO: 444 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAAWSALAQ

SEQ ID NO: 445 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAAWRALAQ

SEQ ID NO: 446 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAQLAA

SEQ ID NO: 447 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWAALAA

SEQ ID NO: 448 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWAQLAA

SEQ ID NO: 449 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALA

SEQ ID NO: 450 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAALA

SEQ ID NO: 451 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWKALA

SEQ ID NO: 452 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Ornithine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWXALA

SEQ ID NO: 453 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWQALA

SEQ ID NO: 454 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAQLA

SEQ ID NO: 455 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHYWDQLAS

SEQ ID NO: 456 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHFWEQLAS

SEQ ID NO: 457 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWHQLAS

SEQ ID NO: 458 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWKQLAS

SEQ ID NO: 459 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Ornithine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWXQLAS

SEQ ID NO: 460 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHYWSQLAS

SEQ ID NO: 461 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHWWEQLAS

SEQ ID NO: 462 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHWWAQLAS

SEQ ID NO: 463 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWHQLAS

SEQ ID NO: 464 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWKQLAS

SEQ ID NO: 465 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Ornithine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWXQLAS

SEQ ID NO: 466 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAHWWSQLAS

SEQ ID NO: 467 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANYWALLAQ

SEQ ID NO: 468 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANLWAQLAQ

SEQ ID NO: 469 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANYWALLAA

SEQ ID NO: 470 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFANLWAQLAA

SEQ ID NO: 471 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWALLAQ

SEQ ID NO: 472 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAALWAQLAQ

SEQ ID NO: 473 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFANYWALLAQ

SEQ ID NO: 474 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFANLWAQLAQ

SEQ ID NO: 475 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (9)..(9): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAAYWALLAA

SEQ ID NO: 476 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAALWAQLAA

SEQ ID NO: 477 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LAFAAYWAALAA

SEQ ID NO: 478 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (11)..(11): 2-aminoisobutyric acid
  C-term NH2
  Crosslinked Sequence
FAAYWEXLAAX

SEQ ID NO: 479 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAQLAAA

SEQ ID NO: 480 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAXLAAA

SEQ ID NO: 481 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWSXLAAA

SEQ ID NO: 482 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAS

SEQ ID NO: 483 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAT

SEQ ID NO: 484 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAL

SEQ ID NO: 485 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLAAQ

SEQ ID NO: 486 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAFWEXLAAA

SEQ ID NO: 487 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAWWEXLAAA

SEQ ID NO: 488 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEXLASA

SEQ ID NO: 489 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAAA

SEQ ID NO: 490 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWELLAAA

SEQ ID NO: 491 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEXLAXA

SEQ ID NO: 492 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (10)..(10): Norleucine
  C-term NH2
  Crosslinked Sequence
FAAYWEXLALA

SEQ ID NO: 493 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): 2-aminoisobutyric acid
  MOD_RES (9)..(9): Alpha-Me S5-pentenyl-alanine olefin amino acids connected by an all-carbon i to i+4 crosslinker comprising one double bond
  MOD_RES (10)..(10): Norleucine
  C-term NH2
  Crosslinked Sequence
FAAYWEXLALA

SEQ ID NO: 494 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (10)..(10): Norleucine
  C-term NH2
  Crosslinked Sequence
FAAYWEALALA

SEQ ID NO: 495 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Norleucine
  MOD_RES (9)..(9): Alpha-Me S5-pentenyl-alanine olefin amino acids connected by an all-carbon i to i+4 crosslinker comprising one double bond
  MOD_RES (10)..(10): Norleucine
  C-term NH2
  Crosslinked Sequence
FAAYWELLALA

SEQ ID NO: 496 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): 2-aminoisobutyric acid
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEXLAX

SEQ ID NO: 497 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Norleucine
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWELLAX

SEQ ID NO: 498 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEALAX

SEQ ID NO: 499 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAFWAQLAS

SEQ ID NO: 500 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAWWAQLAS

SEQ ID NO: 501 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQIAS

SEQ ID NO: 502 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 503 - protein, 13 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLASA

SEQ ID NO: 504 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAWWAQLAA

SEQ ID NO: 505 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQIAA

SEQ ID NO: 506 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAA

SEQ ID NO: 507 - protein, 13 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAAA

SEQ ID NO: 508 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHWWAQLAS

SEQ ID NO: 509 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHRWAQLAS

SEQ ID NO: 510 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHKWAQLAS

SEQ ID NO: 511 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAW

SEQ ID NO: 512 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Abu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWXALAA

SEQ ID NO: 513 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (3)..(3): Abu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAXYWEALAA

SEQ ID NO: 514 - protein, 14 aa, Artificial Sequence
  Description of Artificial Sequence: Synthetic peptide
  N-term Ac
  MOD_RES (1)..(1): Norleucine
  MOD_RES (5)..(5): Alpha-methyl R8-octenyl-alanine olefin amino acid connected by an all-carbon crosslinker that is fully saturated
  MOD_RES (12)..(12): Alpha-methyl S5-pentenyl-alanine olefin amino acid connected by an all-carbon crosslinker that is fully saturated
  C-term NH2
  Crosslinked Sequence
LPRFANYWRLLAQN

SEQ ID NO: 515 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
TSFAHYWAQLAS

SEQ ID NO: 516 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
LTFAAYWAQLAS

SEQ ID NO: 517 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
HTFAHYWAQLAS

SEQ ID NO: 518 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LHFAHYWAQLAS

SEQ ID NO: 519 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHHWAQLAS

SEQ ID NO: 520 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWHQLAS

SEQ ID NO: 521 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAHLAS

SEQ ID NO: 522 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAH

SEQ ID NO: 523 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHPr
  Crosslinked Sequence
LTFAHYWAQLAS

SEQ ID NO: 524 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHsBu
  Crosslinked Sequence
LTFAHYWAQLAS

SEQ ID NO: 525 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHiBu
  Crosslinked Sequence
LTFAHYWAQLAS

SEQ ID NO: 526 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHBn
  Crosslinked Sequence
LTFAHYWAQLAS

SEQ ID NO: 527 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHPe
  Crosslinked Sequence
LTFAHYWAQLAS

SEQ ID NO: 528 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHChx
  Crosslinked Sequence
LTFAHYWAQLAS

SEQ ID NO: 529 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAAYWAQLAS

SEQ ID NO: 530 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
STFAAYWAQLAS

SEQ ID NO: 531 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LEFAAYWAQLAS

SEQ ID NO: 532 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LSFAAYWAQLAS

SEQ ID NO: 533 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAQLAS

SEQ ID NO: 534 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFASYWAQLAS

SEQ ID NO: 535 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWEQLAS

SEQ ID NO: 536 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAELAS

SEQ ID NO: 537 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWASLAS

SEQ ID NO: 538 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAE

SEQ ID NO: 539 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 540 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 541 - protein, 12 aa, Artificial Sequence
  Description of Artificial Sequence: Synthetic peptide
  N-term Ac
  MOD_RES (3)..(3): 3,3-diphenyl-Ala
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 542 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Tert-butyl-Gly
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 543 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 544 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl6br-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 545 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl6f-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 546 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl4m-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 547 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl5cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 548 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl7m-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 549 - protein, 12 aa, Artificial Sequence
  Description of Artificial Sequence: Synthetic peptide
  N-term Ac
  MOD_RES (4)..(4): Alpha-methyl R8-octenyl-alanine olefin amino acid connected by an all-carbon crosslinker that is fully saturated
  MOD_RES (11)..(11): Alpha-methyl S5-pentenyl-alanine olefin amino acid connected by an all-carbon crosslinker that is fully saturated
  C-term NH2
  Crosslinked Sequence
LTFAHYWAQLAA

SEQ ID NO: 550 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): (S)-2-amino-3-(7-methoxy-2-oxo-2H-chromene-3-yl) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHXWAQLAS

SEQ ID NO: 551 - protein, 12 aa, Artificial Sequence
  Description of Artificial Sequence: Synthetic peptide
  N-term Ac
  MOD_RES (6)..(6): (S)-2-amino-3-(7-methoxy-2-oxo-2H-chromene-3-yl) propanoic acid
  C-term NH2
  Crosslinked Sequence
LTFEHXWAQLTS

SEQ ID NO: 552 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): (S)-2-amino-3-(7-methoxy-2-oxo-2H-chromene-3-yl) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHXWAQLAS

SEQ ID NO: 553 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEALAXA

SEQ ID NO: 554 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEAIAAA

SEQ ID NO: 555 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (8)..(8): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAAA

SEQ ID NO: 556 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Alpha-Me-Leu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWELLAAA

SEQ ID NO: 557 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWQALAAA

SEQ ID NO: 558 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAALAAA

SEQ ID NO: 559 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Abu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWXALAAA

SEQ ID NO: 560 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (6)..(6): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWLALAAA

SEQ ID NO: 561 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (3)..(3): Abu
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAXYWEALAAA

SEQ ID NO: 562 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (3)..(3): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FALYWEALAAA

SEQ ID NO: 563 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAFYWEALAAA

SEQ ID NO: 564 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 565 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Adamantyl-Gly
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 566 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Indanyl-Gly
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 567 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWAQLAAA

SEQ ID NO: 568 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAALWAQLAQ

SEQ ID NO: 569 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAAA

SEQ ID NO: 570 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Norleucine
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWELLAAA

SEQ ID NO: 571 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): 2-aminoisobutyric acid
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEXLAX

SEQ ID NO: 572 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Norleucine
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWELLAX

SEQ ID NO: 573 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEALAX

SEQ ID NO: 574 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (10)..(10): Abu
  C-term NH2
  Crosslinked Sequence
FAAYWEXLAXA

SEQ ID NO: 575 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (7)..(7): Aminocyclopropane carboxylic acid residue
  MOD_RES (9)..(9): Alpha-Me S5-pentenyl-alanine olefin amino acids connected by an all-carbon i to i+4 crosslinker comprising one double bond
  MOD_RES (10)..(10): Norleucine
  C-term NH2
  Crosslinked Sequence
FAAYWEXLALA

SEQ ID NO: 576 - protein, 12 aa, Artificial Sequence
  Description of Artificial Sequence: Synthetic peptide
  N-term H
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 577 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 578 - protein, 12 aa, Artificial Sequence
  Description of Artificial Sequence: Synthetic peptide
  N-term mdPEG7
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 579 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (4)..(4): Phosphoromethylphenylalanine-Et
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAFWEALAA

SEQ ID NO: 580 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 581 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAA

SEQ ID NO: 582 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWWQLAS

SEQ ID NO: 583 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWWQLAS

SEQ ID NO: 584 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWWQLAS

SEQ ID NO: 585 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWWQLAA

SEQ ID NO: 586 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWWQLAA

SEQ ID NO: 587 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 588 - protein, 12 aa, Artificial Sequence
  Description of Artificial Sequence: Synthetic peptide
  N-term Ac
  MOD_RES (3)..(3): Phe-2F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 589 - protein, 12 aa, Artificial Sequence
  Description of Artificial Sequence: Synthetic peptide
  N-term Ac
  MOD_RES (3)..(3): Phe-3F
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 590 - protein, 12 aa, Artificial Sequence
  Description of Artificial Sequence: Synthetic peptide
  N-term Ac
  MOD_RES (3)..(3): Phe-34F2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 591 - protein, 12 aa, Artificial Sequence
  Description of Artificial Sequence: Synthetic peptide
  N-term Ac
  MOD_RES (3)..(3): Phe-35F2
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 592 - protein, 10 aa, Artificial Sequence
  Description of Artificial Sequence: Synthetic peptide
  N-term Ac
  MOD_RES (1)..(1): Phe-3Cl
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 593 - protein, 11 aa, Artificial Sequence
  Description of Artificial Sequence: Synthetic peptide
  N-term Ac
  MOD_RES (1)..(1): Phe-3Cl
  MOD_RES (2)..(2): Alpha-Me R8-octenyl-alanine olefin amino acids connected by an all-carbon i to i+7 crosslinker comprising one double bond
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAAA

SEQ ID NO: 594 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAAA

SEQ ID NO: 595 - protein, 9 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALA

SEQ ID NO: 596 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Two pentenyl-alanine olefin side chains where one side chain is not crosslinked
  C-term NH2
  May or may not be a Crosslinked Sequence
LTFAHYWAQLAS

SEQ ID NO: 597 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHsBu
  Crosslinked Sequence
LTFAHYWAQLAS

SEQ ID NO: 598 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
STFAAYWAQLAS

SEQ ID NO: 599 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAELAS

SEQ ID NO: 600 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAE

SEQ ID NO: 601 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 602 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 603 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 604 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQGAS

SEQ ID NO: 605 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 606 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 607 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 608 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQAAS

SEQ ID NO: 609 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 610 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQAAS

SEQ ID NO: 611 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 612 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 613 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQGAS

SEQ ID NO: 614 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 615 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 616 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 617 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQGAS

SEQ ID NO: 618 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 619 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Homo-Phe
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 620 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Phe-3CF3
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 621 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Phe-3Me
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 622 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): 1-Naphthylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 623 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Biphenylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 624 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAFYWAQLAA

SEQ ID NO: 625 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHAm
  Crosslinked Sequence
LTFAHYWAQLAS

SEQ ID NO: 626 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHiAm
  Crosslinked Sequence
LTFAHYWAQLAS

SEQ ID NO: 627 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnPr3Ph
  Crosslinked Sequence
LTFAHYWAQLAS

SEQ ID NO: 628 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnBu3,3Me
  Crosslinked Sequence
LTFAHYWAQLAS

SEQ ID NO: 629 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnPr
  Crosslinked Sequence
LTFAHYWAQLAS

SEQ ID NO: 630 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnEt2Ch
  Crosslinked Sequence
LTFAHYWAQLAS

SEQ ID NO: 631 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHHex
  Crosslinked Sequence
LTFAHYWAQLAS

SEQ ID NO: 632 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHmdPeg2
  Crosslinked Sequence
LTFAAYWAQLAS

SEQ ID NO: 633 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHmdPeg2
  Crosslinked Sequence
LTFAAYWAQLAA

SEQ ID NO: 634 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHmdPeg4
  Crosslinked Sequence
LTFAAYWAQLAA

SEQ ID NO: 635 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl4m-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 636 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): dl5cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWEALAA

SEQ ID NO: 637 - protein, 12 aa, Artificial Sequence
  Description of Artificial Sequence: Synthetic peptide
  N-term Ac
  MOD_RES (3)..(3): Homo-Phe
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 638 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAAYWAQLAS

SEQ ID NO: 639 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAAYWAQLAS

SEQ ID NO: 640 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWVQLAS

SEQ ID NO: 641 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAALAA

SEQ ID NO: 642 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAVYWAQLAA

SEQ ID NO: 643 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAIYWAQLAS

SEQ ID NO: 644 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAVYWSQLAS

SEQ ID NO: 645 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAFYWAQLAS

SEQ ID NO: 646 - protein, 12 aa, Artificial Sequence
  Description of Artificial Sequence: Synthetic peptide
  N-term Ac
  MOD_RES (1)..(1): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ATFAVYWSQLAS

SEQ ID NO: 647 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFALYWSQLAS

SEQ ID NO: 648 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAFYWAQLAS

SEQ ID NO: 649 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAVYWAQLAS

SEQ ID NO: 650 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAWYWAQLAS

SEQ ID NO: 651 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
VTFAAYWSQLAS

SEQ ID NO: 652 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAFYWSQLAS

SEQ ID NO: 653 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAIYWAQLAS

SEQ ID NO: 654 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAVYWSQLAS

SEQ ID NO: 655 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFALYWSQLAS

SEQ ID NO: 656 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
YTFAFYWSQLAS

SEQ ID NO: 657 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (7)..(7): 6cl-Trp
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWEALAA

SEQ ID NO: 658 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (7)..(7): 6cl-Trp
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWSQLAS

SEQ ID NO: 659 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWSALAA

SEQ ID NO: 660 - protein, 11 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWQALAAA

SEQ ID NO: 661 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LHFAAYWAQLAS

SEQ ID NO: 662 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 663 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAHWAQLAS

SEQ ID NO: 664 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAHLAS

SEQ ID NO: 665 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAH

SEQ ID NO: 666 - protein, 12 aa, Artificial Sequence
  Description of Artificial Sequence: Synthetic peptide
  N-term H
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAA

SEQ ID NO: 667 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
HHFAAYWAQLAS

SEQ ID NO: 668 - protein, 14 aa, Artificial Sequence
  Description of Artificial Sequence: Synthetic peptide
  N-term Ac
  MOD_RES (1)..(1): D-Ala
  MOD_RES (2)..(2): 2-aminoisobutyric acid
  MOD_RES (6)..(6): Alpha-Me R8-octenyl-alanine olefin amino acids connected by an all-carbon i to i+7 crosslinker comprising one double bond
  MOD_RES (13)..(13): Alpha-Me S5-pentenyl-alanine olefin amino acids connected by an all-carbon i to i+4 crosslinker comprising one double bond
  C-term NH2
  Crosslinked Sequence
AXWTFAVYWSQLAS

SEQ ID NO: 669 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
XWTFAHYWAQLAS

SEQ ID NO: 670 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acids connected by an all-carbon i to i+7 crosslinker comprising one double bond
  MOD_RES (13)..(13): Alpha-Me S5-pentenyl-alanine olefin amino acids connected by an all-carbon i to i+4 crosslinker comprising one double bond
  C-term NH2
  Crosslinked Sequence
XAWTFAHYWAQLAS

SEQ ID NO: 671 - protein, 13 aa, Artificial Sequence
  Description of Artificial Sequence: Synthetic peptide
  N-term Ac
  MOD_RES (1)..(1): D-Phe
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
FWTFAHYWAQLAS

SEQ ID NO: 672 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acids connected by an all-carbon i to i+7 crosslinker comprising one double bond
  MOD_RES (13)..(13): Alpha-Me S5-pentenyl-alanine olefin amino acids connected by an all-carbon i to i+4 crosslinker comprising one double bond
  C-term NH2
  Crosslinked Sequence
XWWTFAHYWAQLAS

SEQ ID NO: 673 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFALYWSQLAS

SEQ ID NO: 674 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFALYWSQLAS

SEQ ID NO: 675 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (12)..(12): D-Ala
  C-term NH2
  Crosslinked Sequence
LTFAAYWSQLAA

SEQ ID NO: 676 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWARLAA

SEQ ID NO: 677 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAHLAA

SEQ ID NO: 678 - protein, 12 aa, Artificial Sequence
  Description of Artificial Sequence: Synthetic peptide
  N-term Ac
  MOD_RES (1)..(1): D-Ala
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ATFAAYWAQLAS

SEQ ID NO: 679 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
XTFAAYWAQLAS

SEQ ID NO: 680 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAAYWAQLAS

SEQ ID NO: 681 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAAYWAQLAS

SEQ ID NO: 682 - protein, 12 aa, Artificial Sequence
  Description of Artificial Sequence: Synthetic peptide
  N-term Ac
  MOD_RES (1)..(1): NmLeu
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 683 - protein, 12 aa, Artificial Sequence
  Description of Artificial Sequence: Synthetic peptide
  N-term Ac
  MOD_RES (2)..(2): NmThr
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 684 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LXFAAYWAQLAS

SEQ ID NO: 685 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LGFAAYWAQLAS

SEQ ID NO: 686 - protein, 12 aa, Artificial Sequence
  Description of Artificial Sequence: Synthetic peptide
  N-term Ac
  MOD_RES (3)..(3): NmPhe
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 687 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAYWAQLAS

SEQ ID NO: 688 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAAYWAQLAA

SEQ ID NO: 689 - protein, 12 aa, Artificial Sequence
  Description of Artificial Sequence: Synthetic peptide
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAQLAA

SEQ ID NO: 690 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAAYWSQLAS

SEQ ID NO: 691 - protein, 12 aa, Artificial Sequence
  Description of Artificial Sequence: Synthetic peptide
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAALAS

SEQ ID NO: 692 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Homo-Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 693 - protein, 12 aa, Artificial Sequence
  Description of Artificial Sequence: Synthetic peptide
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQGAS

SEQ ID NO: 694 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 695 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Phe-3CF3
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 696 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): 1-Naphthylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 697 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (10)..(10): Biphenylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQFAS

SEQ ID NO: 698 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAAYWAQLAS

SEQ ID NO: 699 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWVQLAS

SEQ ID NO: 700 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAWWAQLAS

SEQ ID NO: 701 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAVYWSQLAS

SEQ ID NO: 702 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAFYWAQLAS

SEQ ID NO: 703 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFALYWSQLAS

SEQ ID NO: 704 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAFYWAQLAS

SEQ ID NO: 705 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
VTFAAYWSQLAS

SEQ ID NO: 706 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAHWAQLAS

SEQ ID NO: 707 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAH

SEQ ID NO: 708 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAHLAS

SEQ ID NO: 709 - protein, 14 aa, Artificial Sequence
  Description of Artificial Sequence: Synthetic peptide
  N-term Ac
  MOD_RES (1)..(1): D-Ala
  MOD_RES (2)..(2): 2-aminoisobutyric acid
  MOD_RES (6)..(6): Alpha-Me R8-octenyl-alanine olefin amino acids connected by an all-carbon i to i+7 crosslinker comprising one double bond
  MOD_RES (13)..(13): Alpha-Me S5-pentenyl-alanine olefin amino acids connected by an all-carbon i to i+4 crosslinker comprising one double bond
  C-term NH2
  Crosslinked Sequence
AXWTFAVYWSQLAS

SEQ ID NO: 710 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
XWTFAHYWAQLAS

SEQ ID NO: 711 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acids connected by an all-carbon i to i+7 crosslinker comprising one double bond
  MOD_RES (13)..(13): Alpha-Me S5-pentenyl-alanine olefin amino acids connected by an all-carbon i to i+4 crosslinker comprising one double bond
  C-term NH2
  Crosslinked Sequence
XAWTFAHYWAQLAS

SEQ ID NO: 712 - protein, 13 aa, Artificial Sequence
  Description of Artificial Sequence: Synthetic peptide
  N-term Ac
  MOD_RES (1)..(1): D-Phe
  MOD_RES (5)..(5): Alpha-Me R8-octenyl-alanine olefin amino acids connected by an all-carbon i to i+7 crosslinker comprising one double bond
  MOD_RES (12)..(12): Alpha-Me S5-pentenyl-alanine olefin amino acids connected by an all-carbon i to i+4 crosslinker comprising one double bond
  C-term NH2
  Crosslinked Sequence
FWTFAHYWAQLAS

SEQ ID NO: 713 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acids connected by an all-carbon i to i+7 crosslinker comprising one double bond
  MOD_RES (13)..(13): Alpha-Me S5-pentenyl-alanine olefin amino acids connected by an all-carbon i to i+4 crosslinker comprising one double bond
  C-term NH2
  Crosslinked Sequence
XWWTFAHYWAQLAS

SEQ ID NO: 714 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFALYWSQLAS

SEQ ID NO: 715 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): Norleucine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFALYWSQLAS

SEQ ID NO: 716 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  MOD_RES (12)..(12): D-Ala
  C-term NH2
  Crosslinked Sequence
LTFAAYWSQLAA

SEQ ID NO: 717 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWARLAA

SEQ ID NO: 718 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAHLAA

SEQ ID NO: 719 - protein, 12 aa, Artificial Sequence
  Description of Artificial Sequence: Synthetic peptide
  N-term Ac
  MOD_RES (1)..(1): D-Ala
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ATFAAYWAQLAS

SEQ ID NO: 720 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
XTFAAYWAQLAS

SEQ ID NO: 721 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
FTFAAYWAQLAS

SEQ ID NO: 722 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAAYWAQLAS

SEQ ID NO: 723 - protein, 12 aa, Artificial Sequence
  Description of Artificial Sequence: Synthetic peptide
  N-term Ac
  MOD_RES (1)..(1): NmLeu
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 724 - protein, 12 aa, Artificial Sequence
  Description of Artificial Sequence: Synthetic peptide
  N-term Ac
  MOD_RES (2)..(2): NmThr
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 725 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LXFAAYWAQLAS

SEQ ID NO: 726 - protein, 11 aa, Artificial Sequence
  Description of Artificial Sequence: Synthetic peptide
  N-term Ac
  MOD_RES (3)..(3): Alpha-Me R8-octenyl-alanine olefin amino acids connected by an all-carbon i to i+7 crosslinker comprising one double bond
  MOD_RES (10)..(10): Alpha-Me S5-pentenyl-alanine olefin amino acids connected by an all-carbon i to i+4 crosslinker comprising one double bond
  C-term NH2
  Crosslinked Sequence
TFAAYWAQLAS

SEQ ID NO: 727 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAAYWAQLAA

SEQ ID NO: 728 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAQLAA

SEQ ID NO: 729 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
WTFAVYWSQLAS

SEQ ID NO: 730 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
YTFAFYWSQLAS

SEQ ID NO: 731 - protein, 10 aa, Artificial Sequence
  Description of Artificial Sequence: Synthetic peptide
  N-term Ac
  MOD_RES (2)..(2): Alpha-Me R8-octenyl-alanine olefin amino acids connected by an all-carbon i to i+7 crosslinker comprising one double bond
  MOD_RES (5)..(5): 6cl-Trp
  MOD_RES (9)..(9): Alpha-Me S5-pentenyl-alanine olefin amino acids connected by an all-carbon i to i+4 crosslinker comprising one double bond
  C-term NH2
  Crosslinked Sequence
FAAYWSALAA

SEQ ID NO: 732 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAEYWVQLAS

SEQ ID NO: 733 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAEHWAQLAA

SEQ ID NO: 734 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAEYWAQLAS

SEQ ID NO: 735 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAEHWVQLAA

SEQ ID NO: 736 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAEHWAQLAS

SEQ ID NO: 737 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 738 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 739 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Cyclohexylalanine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 740 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQGAS

SEQ ID NO: 741 - protein, 12 aa, Artificial Sequence
  Description of Artificial Sequence: Synthetic peptide
  N-term Ac
  MOD_RES (3)..(3): Phe-3Cl
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQAAS

SEQ ID NO: 742 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (7)..(7): 6cl-Trp
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWSQLAS

SEQ ID NO: 743 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 744 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclobutyl-Ala
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQAAS

SEQ ID NO: 745 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Homo-Leu
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQLAS

SEQ ID NO: 746 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acids connected by an all-carbon i to i+7 crosslinker comprising one double bond
  MOD_RES (10)..(10): Cyclohexylglycine
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHYWAQGAS

SEQ ID NO: 747 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAEYWVALAS

SEQ ID NO: 748 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAEHWAALAA

SEQ ID NO: 749 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAEYWAALAS

SEQ ID NO: 750 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAEHWVALAA

SEQ ID NO: 751 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ITFAEHWAALAS

SEQ ID NO: 752 - protein, 12 aa, Artificial Sequence
  Description of Artificial Sequence: Synthetic peptide
  N-term Pam
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAQLAS

SEQ ID NO: 753 - protein, 12 aa, Artificial Sequence
  Description of Artificial Sequence: Synthetic peptide
  N-term Pam
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAEYWAQLAS

SEQ ID NO: 754 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWLQLAS

SEQ ID NO: 755 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWLQLAS

SEQ ID NO: 756 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEHWLQLAS

SEQ ID NO: 757 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAVYWAQLAS

SEQ ID NO: 758 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWSQLAS

SEQ ID NO: 759 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
ETFAAYWAQLAS

SEQ ID NO: 760 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAEYWAQLAS

SEQ ID NO: 761 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHAm
  Crosslinked Sequence
LTFAHYWAQLAS

SEQ ID NO: 762 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHiAm
  Crosslinked Sequence
LTFAHYWAQLAS

SEQ ID NO: 763 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnPr3Ph
  Crosslinked Sequence
LTFAHYWAQLAS

SEQ ID NO: 764 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnBu3,3Me
  Crosslinked Sequence
LTFAHYWAQLAS

SEQ ID NO: 765 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnBu
  Crosslinked Sequence
LTFAHYWAQLAS

SEQ ID NO: 766 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnPr
  Crosslinked Sequence
LTFAHYWAQLAS

SEQ ID NO: 767 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHnEt2Ch
  Crosslinked Sequence
LTFAHYWAQLAS

SEQ ID NO: 768 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHHex
  Crosslinked Sequence
LTFAHYWAQLAS

SEQ ID NO: 769 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHmdPeg2
  Crosslinked Sequence
LTFAAYWAQLAS

SEQ ID NO: 770 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NHmdPeg2
  Crosslinked Sequence
LTFAAYWAQLAA

SEQ ID NO: 771 - protein, 12 aa, Artificial Sequence
  Description of Artificial Sequence: Synthetic peptide
  N-term Ac
  MOD_RES (4)..(4): Alpha-Me R5-pentenyl-alanine olefin amino acids connected by an all-carbon i to i+4 crosslinker comprising one double bond
  MOD_RES (11)..(11): Alpha-Me S8-octenyl-alanine olefin amino acids connected by an all-carbon i to i+7 crosslinker comprising one double bond
  C-term NH2
  Crosslinked Sequence
LTFAAYWAALAS

SEQ ID NO: 772 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): (S)-2-amino-3-(7-methoxy-2-oxo-2H-chromene-3-yl) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWXQLAS

SEQ ID NO: 773 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): (S)-2-amino-3-(7-methoxy-2-oxo-2H-chromene-3-yl) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAXYWAQLAS

SEQ ID NO: 774 - protein, 12 aa, Artificial Sequence
  Description of Artificial Sequence: Synthetic peptide
  N-term Ac
  MOD_RES (1)..(1): (S)-2-amino-3-(7-methoxy-2-oxo-2H-chromene-3-yl) propanoic acid
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
XTFAAYWAQLAS

SEQ ID NO: 775 - protein, 12 aa, Artificial Sequence
  Description of Artificial Sequence: Synthetic peptide
  N-term H
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAA

SEQ ID NO: 776 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
HHFAAYWAQLAS

SEQ ID NO: 777 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAAYWSQLAS

SEQ ID NO: 778 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): (S)-2-amino-3-(7-methoxy-2-oxo-2H-chromene-3-yl) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAHXWAQLAS

SEQ ID NO: 779 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (8)..(8): (S)-2-amino-3-(7-(diethylamino)-2-oxo-2H-chromene-3-carboxamido) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWXQLAS

SEQ ID NO: 780 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (5)..(5): (S)-2-amino-3-(7-(diethylamino)-2-oxo-2H-chromene-3-carboxamido) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAXYWAQLAS

SEQ ID NO: 781 - protein, 12 aa, Artificial Sequence
  Description of Artificial Sequence: Synthetic peptide
  N-term Ac
  MOD_RES (1)..(1): (S)-2-amino-3-(7-(diethylamino)-2-oxo-2H-chromene-3-carboxamido) propanoic acid
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
XTFAAYWAQLAS

SEQ ID NO: 782 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (6)..(6): (S)-2-amino-3-(7-(diethylamino)-2-oxo-2H-chromene-3-carboxamido) propanoic acid
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAXWAQLAS

SEQ ID NO: 783 - protein, 12 aa, Artificial Sequence
  Description of Artificial Sequence: Synthetic peptide
  N-term Dmaac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 784 - protein, 12 aa, Artificial Sequence
  Description of Artificial Sequence: Synthetic peptide
  N-term Hexac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 785 - protein, 12 aa, Artificial Sequence
  Description of Artificial Sequence: Synthetic peptide
  N-term Napac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 786 - protein, 12 aa, Artificial Sequence
  Description of Artificial Sequence: Synthetic peptide
  N-term Pam
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTFAAYWAQLAS

SEQ ID NO: 787 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYAAQLAS

SEQ ID NO: 788 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids that are not connected by any crosslinker
  MOD_RES (11)..(11): Alpha-Me S5-pentenyl-alanine olefin amino acids that are not connected by any crosslinker
  C-term NH2
LTAAHYWAQLAS

SEQ ID NO: 789 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYFAQLAS

SEQ ID NO: 790 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHWAAQLAS

SEQ ID NO: 791 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYAWQLAS

SEQ ID NO: 792 - protein, 12 aa, Artificial Sequence
  Description of Artificial Sequence: Synthetic peptide
  N-term Ac
  MOD_RES (3)..(3): 2-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYAAQWAS

SEQ ID NO: 793 - protein, 12 aa, Artificial Sequence
  Description of Artificial Sequence: Synthetic peptide
  N-term Ac
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTWAHYWAQLAS

SEQ ID NO: 794 - protein, 12 aa, Artificial Sequence
  Description of Artificial Sequence: Synthetic peptide
  N-term Ac
  MOD_RES (3)..(3): 1-Naphthylalanine
  MOD_RES (4)..(4): Alpha-Me R8-octenyl-alanine olefin amino acids connected by an all-carbon i to i+7 crosslinker comprising one double bond
  MOD_RES (11)..(11): Alpha-Me S5-pentenyl-alanine olefin amino acids connected by an all-carbon i to i+4 crosslinker comprising one double bond
  C-term NH2
  Crosslinked Sequence
LTAAHYWAQLAS

SEQ ID NO: 795 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 796 - protein, 6 aa, Artificial Sequence
  Description of Artificial Sequence: Synthetic 6xHis tag
HHHHHH

What is claimed is:

1. A peptidomimetic macrocycle comprising an amino acid sequence which is at least 60% identical to the amino acid sequence of: SEQ ID NO. 163.

2. The peptidomimetic macrocycle of claim 1, wherein the peptidomimetic macrocycle comprises an amino acid sequence which is at least 80% identical to the amino acid sequence of: SEQ ID NO. 163.

3. The peptidomimetic macrocycle of claim 1, wherein the peptidomimetic macrocycle comprises an amino acid sequence which is at least 90% identical to the amino acid sequence of: SEQ ID NO. 163.

4. The peptidomimetic macrocycle of claim 1, wherein the peptidomimetic macrocycle comprises an amino acid sequence which is at least 95% identical to the amino acid sequence of: SEQ ID NO. 163.

5. The peptidomimetic macrocycle of claim 1, wherein the peptidomimetic macrocycle comprises an amino acid sequence which is: SEQ ID NO. 163.

6. The peptidomimetic macrocycle of claim 1, wherein the peptidomimetic macrocycle comprises a helix.

7. The peptidomimetic macrocycle of claim 1, wherein the peptidomimetic macrocycle comprises an α-helix.

8. The peptidomimetic macrocycle of claim 1, wherein the peptidomimetic macrocycle comprises an α,α-disubstituted amino acid.

9. The peptidomimetic macrocycle of claim 1, wherein the peptidomimetic macrocycle comprises a crosslinker linking the α-positions of at least two amino acids within the peptidomimetic macrocycle.

10. The peptidomimetic macrocycle of claim 9, wherein at least one of the two amino acids is an α,α-disubstituted amino acid.

11. The peptidomimetic macrocycle of claim 1, wherein the peptidomimetic macrocycle has the formula:

Formula I

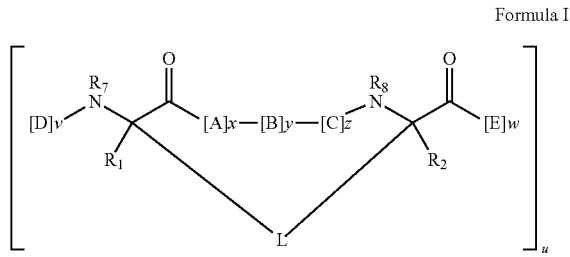

wherein:
each A, C, D, and E is independently a natural or non-natural amino acid, and each D and E independently optionally includes a capping group;
each B is independently a natural or non-natural amino acid, amino acid analog, or

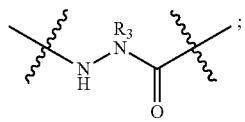

each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;
each L is independently a macrocycle-forming linker of the formula $-L_1-L_2-$;
each $L_1$ and $L_2$ is independently alkylene, alkenylene, alkynylene, heteroalkylene, cycloalkylene, heterocycloalkylene, cycloarylene, heterocycloarylene, or [—$R_4$—K—$R_4$—], each optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$;
each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, each optionally substituted with $R_5$, or forms part of a cyclic structure with a D residue;
each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, each optionally substituted with $R_5$, or forms part of a cyclic structure with an E residue;
each v and w is independently an integer from 1-1000;
u is an integer from 1-10;
each x, y and z is independently an integer from 0-10; and
each n is independently an integer from 1-5.

12. The peptidomimetic macrocycle of claim 11, wherein L does not include a thioether or a triazole.

13. The peptidomimetic macrocycle of claim 1, wherein the peptidomimetic macrocycle comprises a cross linker linking a backbone amino group of a first amino acid within the peptidomimetic macrocycle to a second amino acid within the peptidomimetic macrocycle.

14. The peptidomimetic macrocycle of claim 13, wherein the peptidomimetic macrocycle has the formula (IV) or (IVa):

Formula (IV)

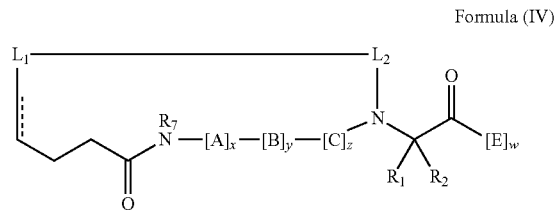

Formula (IVa)

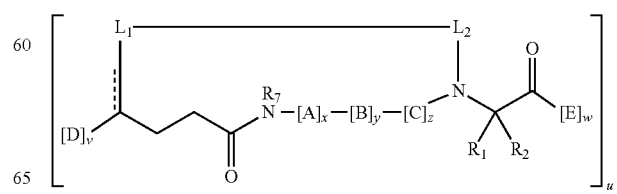

wherein:

each A, C, D, and E is independently a natural or non-natural amino acid, and each D and E independently optionally includes a capping group;

each B is independently a natural or non-natural amino acid, amino acid analog, or

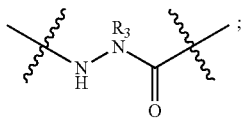

each $R_1$ and $R_2$ is independently —H, alkyl, alkenyl, alkynyl, arylalkyl, cycloalkyl, cycloalkylalkyl, heteroalkyl, or heterocycloalkyl, each non-H group being unsubstituted or substituted with halo-, or part of a cyclic structure with an E residue;

each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, each non-H group being optionally substituted with $R_5$;

each $L_1$ and $L_2$ is independently alkylene, alkenylene, alkynylene, heteroalkylene, cycloalkylene, heterocycloalkylene, cycloarylene, heterocycloarylene, or [—$R_4$—K—$R_4$—], each optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$;

each v and w is independently an integer from 1-1000;

u is an integer from 1-10;

each x, y and z is independently an integer from 0-10; and each n is independently an integer from 1-5.

15. The peptidomimetic macrocycle of claim 14, wherein $L_1$ and $L_2$ either alone or in combination do not include a thioether or a triazole.

16. The peptidomimetic macrocycle of claim 11, wherein $L_1$ and $L_2$ are independently alkylene, alkenylene or alkynylene.

17. The peptidomimetic macrocycle of claim 11, wherein $L_1$ and $L_2$ are independently $C_3$-$C_{10}$ alkylene or $C_3$-$C_{10}$ alkenylene.

18. The peptidomimetic macrocycle of claim 17, wherein $L_1$ and $L_2$ are independently $C_3$-$C_6$ alkylene or $C_3$-$C_6$ alkenylene.

19. The peptidomimetic macrocycle of claim 11, wherein $R_1$ and $R_2$ are H.

20. The peptidomimetic macrocycle of claim 11, wherein $R_1$ and $R_2$ are independently alkyl.

21. The peptidomimetic macrocycle of claim 11, wherein $R_1$ and $R_2$ are methyl.

22. A pharmaceutical composition comprising the peptidomimetic macrocycle of claim 1.

* * * * *